United States Patent 10,233,495 (METHODS AND COMPOSITIONS FOR SCREENING AND TREATING DEVELOPMENTAL DISORDERS) - sequence listing, part 2

SEQ ID NO: 13 - DNA, 3437234 bp, Homo sapiens (residues 1-1,718,617 of 3,437,234)
aactgaatgctaacctgaaatcatgaacagtaaaagcagatggtcaattaaggtcttgaggaaagttgtgcaaccagggaatgaacatatttcttcatgatattcccagaggaaggttgcatttataccctgaattaggaagattccacgtgtgttctactgaccctgccatgctactgctatggtgtgtgcagctgaaaattactctgtcaatgattgccaggttaaagacaagaaagaggatcagttataactggactttgcctagggtgcaatttcttagtttgcttatttttttttacatacttcttatccaatttgtaggctaattttttcttcccttggattgtgattttagaccattttaataattttaaataaatataaataacagtaacagtatctctaccataaagcagaataagacaaaaaagaatatgtttaggattaatgtttaaagtcactggtggaaaaaaatgctggttggaatagtttagaaacatatttaagtttaattatacaagttataattatttccagttatttatctaattgatggtcctgattagaaatatatcaataaatcaaatatttattcaatttgacaaaaagtgctttagaattgaacagcaacaccttggtgtatagaaattcatttaaaactagtatttttacacaatgttttgcctcttctgatattaaattcttttgaggcacaaaaagaagccataccgagcggttggtgcagacaggcgtgaatgcattggtcccacaggtgaataaccggtcgccacccaccagaagcacccggatgtagttctgacattcctcctgagggaaaataaataaattaattaaaaatatatatatatatgtataatgataaacatgctaacaaagtctgagcacaagaagaatggtgagaaggaatacattttatctaataaatatgtaagccattaataaaatgtaaaccattaaaacaacaaataaacctttcagatattgaccaaaaaataacaacagagctattaaacaatttgatttttatcaaataaatttaattgctgtatctgcaccttgtttgataaaaaatatgaagataaatacatgttcaattaaattctcaaagcatgcatctaattttgacagaaatgatttcattttgaattgtatctgatagtagcacaaatgctaaatggccttggacgggtattaggaaaataaataaaaggaacctattagatgtcgctcgggaagcagtgccttggaaaacttcctcagactttgagaaaatgctgcaagcgctttttgatcagaaggtcacatgagaaactctgtacacaaactggagcaaattttactttatgggatccaactgcatattttaaatacaaagcaagtatctatatgaatttttttttttttttttgagacggagtctcgctctgtcgcccaggctggagtgccgtggtgcaaattcggctcactgcaagctctgcctcccaggttcatgccattctcctgcctcagcctcccgagtagctgggactacaggtgcccgccaccacgcccggccaattttttgtatttttagtagagacagggtttcaccatgttagtcaggatggtcttgatctcttgacctcgtgatctacctgcctcggcctcccaaagtgctgggattacaggcgtgagccgccacgcccggcctgtataggcatttttaattcattgattgaaaagtgaaaatatgcttaatgaggacaagatgttcgaaacatttgggacaaaaccctaggctgagggatactccaagaatggagtactttttgtggttgcaaagtgttcttagaaaaccctgggtatggtcatagcagtgatggacatgtgagctggagagctcctcacttattcagcaagcattcactgagtagctcctctttggtagccactgggttagaagtctcaatccaggctcctggcagaaaaatacaggatcatgacaattaccacagagctgtccatgcactgtaatgaggacacacagaggaatagcatattacgtagctccaaaggaacagggaagggaagaggtgtagagaggcttcctgaaggagctgacaactaagtgttaaataaagtgtaaggtttagtgaggcttcctggagggggtgcttgtaggacacctgttggactttactgagcaaaggagggaaaagacactccactcaagaggagcagactgtgtcaaagtgtcgtggctagagaaagcatggcgctctcattgtgtacagaggagctcacatagaagccgaggagcctgaaacaggccaagtgtgcccaggtagtgagttcacatgttactctgaatgtgaaaggagccattacatgttttgactgcgtgaagtattgatgagctctcatgttttatcactgaagaagcactcagaaaccaatgtgcaggataagctgaagagagaagcctggagtcaggaagccaaggaggaagtcacttccataactcaggctcttgtcatttcatgcctagaccaaggtagtaggtgtgaaaggacaaagccagaatagtgagtcaattgcacgccatggcgaatgaatgacgcacgaggcatgaaagatgctgcatgataacatgatgatttgaatcacatcatgctggaaatcaggggaatctggatgtaatggtatagctcatcttctcttcaaccaaatggacccccactctagatgaaagtgttaatttcccataacccagtctactgcatagcatcgagacagcggaaatgcatagtgctaatttctgtattttctttactagagacagggttctgtcatgctgcccaggctggtctcgaactcctgggctcaaatgatcctcccaccttggcctctcaaagtgctgggattacaggtgcgagcaccactcctggctcagattggcttctaaatgtaaagtgaaataccaagggtggattatcctcctaacattattcctaacagtaatagtaaccacttatcattggaagctgaactgaggaagatggaaaacaaccacaaagacctaagtagacttcagaagaattaccaaatgctcgtaaacagtagacagtgaatctggtaactgagaaaggtacaccagaggtgggaggcttgtcttgttttgttctcttttgtttttattcctggggaagggtcaggagagttctaaagggaaagaacaaaacaaaagacttcaaagaaccacacagtacttccttcccaggctgaagagaacacaggagggccagggaagaaactagaggggtacgggagcctataaaggcaggcagagtgaggataaaagaaggaagccgatgcctgtcagaggagacccacaaagacatcttccagaacacagggctgagcaagctgatggacttaatggatgacacagacatattaatgacaccatcataaggactgggatggaaaattacaaacagaatagaagggtgaggttttgtttgttttttgatgctgcttttagaactcttttaaaagcaaggcaagatgtaataaaactttttcctttaaaaaaaaaaaaaaagcaagagcttgccccaaggtaaaccacaaacaacatgggcaagggtaatttgttccaggagaatcatctggattgaaaagatgtgatttcacagcagagttctacagccctggtgaagagaaagcaagggcctccagtcaattatggaaaggagaataaccaagatatcaaatatggtgtttacgttaatttcccaaaggaagaacaaagtgcaaataagactgtaggttgctttcttttgtttttgtttttgttttttgagacaagggttcactctgttgcccaggctggagtgcagtggcacaatcgtggttcactgcagcctcgaccacttgggctcaagtgatcctctcacctcagtctcccaagtagctcggattacacgtgtatgccaccacccctggctatttttttcttttttttttttttttttttttgtagggtcaaggactcattatgttgcccaggctggtctcgaattcctgggttcaagggatcctcctgccttgtcctcccaaagtgctgggattgcaggcatgagccacagtgccctgcaactataggttaacattcctgaagaccactctcaaggttgacgaagaaccagcatgttggtcagaatgtgtgataaccatggtaaccatggtgcagcagtgtgccagggaggggcagtgcaaacccagctggtagtgtaagaatatcagagaaaaagtaaatgaggaaagggacagaattatttcaattagggcagagaatgaaagagcacgttctgatcattaagaccacgtgagaatacatgaagacactggctctattattggcgatgagccacatccccatgtgtcactggtgttcttcgcagaacggagtgagtgtgtggaaaaaaaggaggaagatgtcagggatccagatgatcaggcaaggaggtctgtgcagaatttttataaaatgatggagggtggccccagccctatggaacccagaggagcctgtggcaatcaggagctaatgaaggagggtagtagtgtagttggccccagccttaactagaggtctgagttatcaccaataacagtaggtgtgctcattcactgagtcctacaggagcaacgagtggaggtgggtggtattcgagtttcttcttaactgtcaagagcataactcagtcacccaactggctaagggcatctcacgtacttcccgttcttactcccttaaaggcatcctcatgtttaattcacagattgtgaattccagatgtgaattccaaacaaattcatttaaaataataaatgttttgaaaagagagattgggacaagttcaactgaaacagaatgtgaaaacacagggaaaaaaaagaaagtagaagtatttagcttttgagcagaagataaatttgggaattggacagtcaatactgtgaataaaaggaaatgagtggctgggcacggtggttccatgcctgtaatcccagcactttggaacgccaaggcaggcagatcacctgaggtcaggagttcgagaccagcctggccaacatgaaaccccatgcctactaaaaatacaaaagttagccaagtgtggtaatgcatgcctgtaaccccagctactactcaagagactgaagtgggagaatttcttgaactcaggaggcggagcttacagtgagccaagatggcgccactgcactccagcctgagtacagagcaagactccatctcaaaaaaaaaaaaaaaaaaaaaaaaaaaatggaaatgagtaaccgttccaggctgtgtaataattagtctcctcttgatggtgttttcaaaactcaaattctcttgcagatccactggcaacgcactttgccaatctctgttacaaacgtggcctttccatgggttacctgaacttgcttgaagtactgcttggagtcacaatgtagaggtagagtcacaatgtagaagtccctttaggagattcttttaaaggtttctcttataaatcagcatacttaaatgtctatgattttccttttgtcatctaagaattttttcttctagcccatttctgtaacttgaaaataggtgaagaggatttaatgaattctgattttccaagaagtcacagtgcacatctccaaggcctctagcagcttgctgccacaaggcttctagggttgataatgagagtcatctatctacattttgatcacagcacttgaacattaaaatgacccatgtgggcctgtgatccacagacgtatcaacctgtccttgacttcaaggcaattgatagccgaggagcatggttgctgactcatagaaagggcttttacatggagactggccaatacccacttggtctcaaggacacaaggccccagccccagcagagaaaacatgttttagggctgttttcttaatgaattaattggttttgtcatatagcatttcatgatttttttttaaacaggtatgttctgtggatccctcaggtatctcttcagcaatacccagcccgtcgcccagcccactaattttagggaggaaaggtaagggttagaaggctacaggctttatgttaatcatagtgctcccagtgaaatcaatgtgtcctcttcataatgtgttatctttgtcagcatcaaagtgctgaagaagagcaatttacaggaattgcatgagcctttcaaagttgaacccacatcaacctaaatcatgattacctggtgactcttgcaaaaccatacctaaccaaatcagatgtatgtgtgtatgtgtgtgtgtataaaggttgtatctatataattgtatacatgtattacttgtgaatatatgcacatgcaaatcacagatgcaatatgtagagataaacactcatatacatatattacgtgctatgtaatgtacagtgtattgatatataaaatatactatactgtatatatgtacatactctattttcaactgagctgacttcatgggaaacctttttggatacctcaattaaaaaaaataaaattaggtgtgcataatctaattttaacctaatgttagtatttaacctaaagtaccctcaatttttaaagcaattacataaaataaaagcagggctacaatgtgtcccatgtattgattaactcacagctttcaaaatattggcacttaggtacaaaatgtcaagatccagccctacaccagcaggcacttaggtagtatggtgtcatgagtttcttctcctgttcactaggagtttacctctttaccagcataatttgacaacttggtaaacaggaccacaggatatgacagggagaacaatatacatagctctggattctaatcaaaaccctcccactaactagcaaaataattctaggaacttggtgtcaaaaatcctgaaatgagatcatgaacaaaaacttttgaaaatcacaaagtgtaatagaagcatacagcagctctttcattcccataataatcagctgtgtttcctttgtaaagttcctaaatgtcagagtgggaggaacgtcagttcagacattatagcccaacacacacaaggaactcttgttaggtcgtgagagaattgactatttgtgtttaaaataatatttgtgtaaaagatacttaagtagttatagaattcagtttctataatgctatgtccagaagaactaaatacaacaggttttattataagtttttgaatccataaaaacagattccccacccccactttttttcccccatggaatatttaagccattgcaggcaaaggcactccctctttcccaagggagctgaacattttctaaataaaatagaattcaaactttacaagggcttggcagcttcagtacctaccttcttttcaaacctggcccaaataaaaaatctggataacttctcttgaccctaattccctaaattgtacttttaatggattatatgtgaaatcatatctgtgtctggatacagacatcccagggaaacaaggggaaatccatcatctctactctcctccactctgcagcaagctgaggaatgctcccatcagaacagcaagtgggcacaggcagtgtcctccctgcacacccagccacctccttccatgcatgcattccagctcagctcagcagctaaatgcattatgtgcagaagcacagaccacttttctcagagtaggaaaaaaaaaaaacaacttcagtttaaattgctggcattcttctcatttttgagatgtcacattttgcattattctttttatttcagggagaagggaaactttgtaattctgttctcataagaacttcagcacaagcaaaactacaaaacagctgaattagccttctaagctcatgaccactaagaaaagtcttcattccattcacccaaagagacgttacctatcagtcaaattgactgtgagaatgttctctgaattggctcctaggaactgtcaaaatggggaaatgtgggttgtctgaattctgagttcagggggcagtccttcggaggctgcatttggtccagttgcccctgttcataggggctgccttgtttctttcccttctctgtcccaggagctgggcttggtcagccagcttggtcacatcatggtcattgttcagttactatgttaagaaagcaagagagatgccaaataagaaagaggaacttataaaggtgggtgaagagccctctcctctcaccacccatgaaccagcccagtgctgtctagaccaacatgtttgtaaagctactgcatcatttttgtacacaggaatttccaatgcacacagctctgctacataaactgagctgtacttcgaagcaacagaagttatttaaactgtctgtgaatttatcaatatacttaaggcaacctaaaagaacgtgtgatttatctttctcagagtacgtggtgcttgacactcatcttcatctgtcttactatattagtgttaaaaaatccattcacaaatgcggtttgagtcaattaataattactaagatttcccattatttttaatccattaaaacccaaagcatgtgaaacataaaggtttgattttacttgaaaatatttgtttccctcatttgctttctgtgtatcaagaaaattcaattaagtgtagtaacgattggtctcctccgtgaatcgagggtatattacctatcggtcccaaaagatggccttttcctaatacttctctgggttcaatttacttaagttctaagcaccaaacaaccaatgatcacggcttaaggcaaaacgtgggctagttcttcttcagcagaagcaatttttcaccccaagtagaaataatctattagcaaaaggcaaccacatagattctttgtaaattatggacttccagactatgaggaggaaaaacccctcgctacatgatggaatctgatgctttgctttagtaggacaaggagtataaggagactgaagctcataaaggggaagggagttaactgttaatttttaaacgtctttgtaacaaatatatacatgtaatcaagatgaaatatgagaggactctagggagcataaaaatcaaaataaacaatgcaaaagtgacaaataaatttgccattttggaaattaaagcagggattcccgaccaggtcaatgtctggcaatgtgtttcctgccatgtatggaatagctgccatgtcaaagcataatctggccccaaatatcaataatgatgaagatgagaaaccctaaattaaagttcactaccctggtatgggcttctcatgttcattcagtcattcagtggaacatctttaaacgctcaccgtgggctgggagtgttaagatcggacgaggaaatagcactgggacctgggagagggaaggagggtggggcccctcaggtctgggctatcagctaaacattttcagaacagacactgtgacaagtgtgcatcaacaatatctgctgctaggttgctcaaatctgaatagtgcttattgatgtgtccatgagacccagaaagaaagaaaaagaggagaggaaagagtcaaagtaccagaaggaagataaagacaagaagaaagagttgagaaaaagcaagagggagagctaggtcactgtattagtctgttctcacactgctaatacctgagactgggtaattttaaaggaaagaggcttaatggactcatagttccacatgactggggagtccacacaatcatagcagcaaatgaaggggaagcaagacacgtcttacatggcagcaggcaagagagcttgtgcaggggaactcccctttaaaaaccatcaggtcttgtgagacttattcagtatcatgagaatagcacagggaagccccacccccacaattcaattaccttcccccaggtctcttctagcacacatgggaattatggaagctataattcaagatggagtttggtggggacacagccaaaccatatcaggcatcacacagagcaacccctgggaggcattgatatccccaggcaaggcccacggcaggccttgagagcatggaacagtggtgcttgcatcagtgaatcttactagttgaaataaagaaagccatctttccacccctcacttcatgtaagtctgactccaggtcccatctcattccttggcacaggtggtcttatttaaaggactgtgctctgaccagtgaagtggggccgagggccgagccacacaacccccacattgagactcaaacaccacagggaggaaaaaggaaactatttagaaatcacctcttcaaaagtcctatacatcatttctacaaactcaacaagaaggttataggggtccccgatgtgtgggctttagattatttatttattttggggagcatttgaggatatcacattcgaattctttgacaattggagtacctttaaatctccttatatctctgatgatttaactcagaggccttttctgcggttaaatatcttccagaaaatacccttcatcaattcctgctttatttcccccttgtctccaagtgtttccctggctaagactgcattttcctccttctcttcttcctactcctttattcagggttgggaaaccccataactaagctggctgacacttgcctcagtgtctgactcccacagcgattcagttaaagggcagggaagcagacaatgaaattgggtaaaaaaaaggtacataacactcttttataaatacagaagggggaggatcttttgccagtgctctctgcatttgctatatttttttccccaaactattggtcctaggaccaactttgcatagcaagccctcttttctactctgtgtataactgctgtcttctgtaacccaaagcataattcaccattggaagtctgtgctccaatataaagtaagaagatcactaacagaataatacacagtgagcctgttcacaagctgcagaagaatttcctcaagttgatcatgaataattttctcaaagacacatagtcttcctggaaaggcaaagaatcacgcatctttttgagccagagaaacatttgaaagaagcctgcaacatgtacaattgctcaagaaacacatttccaaccttagctataaactgcacattctataggaacatgggatgtagattttcgtatgaaaagagagtttattataaagaatatgttaagataaagaatctatcacaaataatattttatgtaataaatttatttgtcatatcattactttctagatttagctgtaaagtaagaaaggaggaatttaaaatatcttaaaaattcaggcccatattttttccagcgctatcaatcaattaatttcttatcttagtctaatgacagaaagggcaaattagctctgatcttcttatgttctgaatcctttttggaaatgattgattgctggggttaattttaatttagtattaaaaacttgagaatataccgtatacatattttgaatcttgcttttttcactttacatggcaccgtaatcaggaatactcttcatatcaacatgctttatatagtgtagagtccttcaagacagggtgatggctgctcataattgcattcttcttacctttgatttgcctttgctgtaacaggcctttttggtagcttcatcacactcccattccacagcctgtagaaaacaccaaaacaatagcagtcatggttttgactaaataaaagggaaaatataaacaaggtaacaaggcactggtaaccagattaggaaatatggctgcatcctggcaccaacattttcatactcatagaatttacaccaaatacatgaaatttagtcatgggcttagatttagctctaatattgaagcataaggaccttcccccttactatttgcttttgggtagtaatgatgggatgcttagatctagtcactgttagaaaggaacaatgagttggtgactatagcactgatggtagaaatgatcacttcagtgaaactatggaatagacccagacgaggcttaagggagaggccttgagacaagataatttaaatattaattttaacatttttattttattcaaataatatgtcatttatcaatattcatagataatgaaggatgattttgcatatccttactaccaagatatacctgtaaatgataatcaatcaatagatagctcatgcaaagaacatagctaggatttttccccagtagcagtcattttcatactattattagctctgactaaatgtttagagccacagcttttaaatattttttctcagaatttccaaatctcacttatgctgattaatttgctatgtgtgcttccacgtctgatgctaactcacaaatgaaatgtgtgattagtgaagaaaacagacagggcttgctttacagaaaggatgcctacaggcatccatggcctagctctcgtgaatagttttttgcgcaaattgaggcacctgggctttttttttttctcttttctatcattgtatagagtgtgaacttttatagggtaaaaatatttttttcattctccatacctgttatcagaattattattttctattttactattaaaattggatttctgaaggaacagggatgtgcggtaattcaatcattaacagaaagacattttgagatagagacttttttctgttaatttggactaatgtcaaataataaactaaaccaaaagcaacctagtgtcaaatcatatgaaggaaaataatggcttcacccttattttttagtaagaaatgttttctttctaattatccaaacttgggagaataacaaagtcaggctaacaccattctctaatatcttctgccttccaaagaatgttacataacagagattaaatcatacaacactgcatcttgtataatttatgttacttggcaaatatgagtccataagaaaagtattctagaaagaaccacttcagtgtctttgaaaccaaaacaatgctataactgttttcccttgtgcagacttgaagatttttgtcagtgtcaacatctgataagagaatttgttaattccttctgtgctgtttccctgttcataatgtttgatggtaacaatacagtcatagctaatcagcatctgatgcaaacacatgatttgaattccataccaggatgacaaatattttcatgaaaagcaatgacacctccagagaaaacagcctcccatacagttgcataactatatccccatgaagtacagataaaataaatgaaaataaatgtgttgttgttcatctgatttgacctttagtatattcctttcttagatctctttacaaaatattactcagtttttttgtatttaagtagatatccacgtcttggcctttacttaaacttaaaacagtattgaggattgattaaaacagtattgaggactgaaagaatatgatatattctttcagcagagtaaaactcattataactttgattgtgtattgccagaggtttcagtattacatatcaccaagaggaactggtgttacacaattactaggaaaactatacagtgaaatactttagataaagagtcattcacggtggctttcattggtctagtgattttgttaaaagttaaataataatgttctcttctataaacatgaaagctataaagagaaggattagtcccagggctaaggaagaagaatatttaccaaatgccatcaaaattgttcagatcctgcggctgaaatggcaaacaaacagcttcacaagtctacctaatgcccaaatagcctttgcattttcaagataaatattggccaaagattgaaagggaaaataagagaagaaagaatgtgagagttttaaaaaatatttcattatttttatccagcataccaaaaaatagcaactgctcttacaagtttattagaccaataataaatatgacaaatcttacagattttctgaagatagtgattagaaagaaaaaaaattaatttcctaaggcattttattacagcctcactagcttgcctataatattcaaatccagaattaattaaagaccatgattgtacagcttttctgttcactttctacctgaatagagaacaggataaagggaaattttatattaagaatggaactttacttattccagaagacagcaggaatatatacatattattggatagcacagaatttgaaaaggaatagaatggagaaaagtggcttttccagattatactagaatgggatgctccagattcatcccatagtgtcctcctattcactaggtcagctagactttgcctatttcatcacttgacagacatgaaattaaaaaaaaaaatccatcagagacaaataagagtatcaatgtacctcctctctgtgggttcttatttctcacagtgacgcatttttctgtttgaaattaggctgtttgtttaacctggtcacaacttccttattcttctagatccattctaatgaaccaaatacctcttaatcaagccttctctttcatttctcagtgaaaatttttattatttcatgtatcatgattatagaacaagtctcactactgatttgagaagccacgtgtccacttgtattcaaaagatgtttttccactaacccaaacctatctttacaatagtcaaaacaagtgctaaagcattctacatttcagatctcaacccaacattcatagtctcatttcctgagtctcccttttaaaaatatttaatttttgtcatcttttgtctttttctatttcaggatagcccagtagagaaaagaaatatttctactctaggctattcaatattttgtctgcattatatatttcagcagcagacatatagcagtaatattgtggttacttgaatattcaaagattagatacagtaggcagtgagtttgaaacacctacattttaaaagacacaacgattcctgtttgcagtaagtttttttctgtaaatacatacaaataatacctgtactaaggaacaactcacagaagttttgctttatgcaaatacattaattatctcctttatttaacaaatattcattaagtacctaccaaacagaagacactcttctatgtgactgacagaaggaaaaacagacatagagatacacatcagatattaatttacaatacagcataagtgtattccatcagcctagacagaattatgttaaatctgaggagtcaacagtgttcattttcattgttatagtagccatatgcacgttaatctcaggtccagtgacacactctaacttataatatcattagctttcaggatgtgacaaacatacaaagagagctacaaaaaaaaaaaaaaaaaagaagaggcttatggaaaacccattttatatctgcataaatcctgggtatgcaacaaagcccccattgtttcaaggtacagcatccattggaccgtgttgcacacagacatactacggttaggataaatggagctgtgatctcaagagtaaatcagatagagaaaagaaaaagagattggctctttttatgtatgtgttacatacatataaatccacagttctcagaagtatataaacaaagctgtgtattatcacactccaccgccagataagttaattagatagggaccagcaaaggcagacacttcataaaaatgaagagaacaacattctaggcaaatgggctactactctttcagcagatggctttgctaattagatactggcaaaagataacattaaacaaaactagtttaattacacaacgccaaaaattaacaaccacctgagggctttcttttttcatatgtttacattcatattcttatgtcatgtattctgcgatgcgctgggaaatgttacattgccatggcaattataaacaaatcgtcagggtatgcaagactatatctttgttcaaaactgaaacaaatgcaaatgagttggaactagaaacaactgtgatttgacttgaataaaatgtcaacctataacagtaactttgagagaggacatctttgctaattataataccttcatggtcacacgtgtcagggtcacacaagtgtcacttgagctagaatggcgtgcattgaacgaaaaaaggcagtaaacatttcagtcaatttggaaggatttgttcgatgttcctctgcctttacttcctagtggatattcaatgtgtttgttattttttcacattaattttcagtatactttcatttccgtccatgtcaaatacaagcaagtacaattataacctcaaaatcaaaagactagccaaacatcttatgttctcactggtatgtgggagctaagctatgagtatgcaaaggcaaaagaatgatacactagactttgaggacttatggggaagagtgggagcggggcaaggcataaaagacaaccaacgtggtgcagtgtatactgctcgggcgatgggtgcaccaggatctcacaaatctccactgaagaacttactcatgtaaccacataccttctctaccccaataacatatgggaaaataaatttttttttaaatgatcaatttcaaaatttagaaattaacttaaaaaagactggaatcgcattagagtcatatcatcccactattttttgattctcatacactgccatcatctaaaattagaagaaatatcttaactttagaaatacctatgaaaatgtgttataataatttttaaagcccttatgctaatgcccaagattttctttcacataataacaccacattaaacttacattgataaggaactgcagagtggtgctcccagcctgttgaatgctcactgggcgttctgttctctaattgggagttgacaatgtattcattccctagagctgttgtgagaaactaccacaaaccaggtggctttaaggacagaaatttattcttacagttctggaggctcgttggcagggttgaatccgactgaaaactttgagggacaatctgtctgggcccctctcccagcccctggggtctgccgctgacctgtggtacgacttggcttacagggcatcactggaacctctgcctcactcatcgcatggtgttctccttgtgtttttctttgtccaaatgttcctcttcttataaggacaccggccactggattaaggcccactgtattccagcaatgagctcatcttaactaatgacatctagaaagactcttttttcaaataaggtcatattctgggaatctgcatggacatgagttttggggtgatactctacaacccagtacaaacagcatggcataagagatttggagaaacaattcatagtcacaaattagggtcattgctttgccacaaattagttgccaattctcaagcaaaataatggtaacaatttattaaatgtgtgatgtgctagctacagtgctaaatgctttctatacacttacctcgtttaatgtgagaggtactattataataagattttggatgaggacttagggtaaataacttgccaaaggccacagagtattaagtggcagccccaggattggcactttataacttggatctggagcctgttatctgaactactctcctgctatttaaattgccaaattaagtgccccttcttacctgatttttacagtttctttgttttccaccccgtaatttagaaaaatacatatctgaagcagagaaatttgtgcatgtctaagttcagagctgttggcattcagtaaatattaatcaaaaaagccattgattcccttgtcatagaatgtattcatgtctaaagcctctgggcccattcacagccctagaatcgattttaaaaggaccatgatttgcctaatgaaactctaaagtcaagaaaggtgcagccagggtatgatataagaatcttgggttggttttgtgaaattaaacatcttctgtataagaacacagtttgttcttgacacagcagcaatgtcctgctttcaaaattcagtctgaagacccatcacttctattaagccctaccggggcttcccacacctcctggattaagagccaaagtcatctagaaaattctgccatgtccaggtacttatttcctagtgcccccaccccattcttttacgggtggcatgggtttctcagcatggtctctgaacaaagcagacacattccctatggcctgtggacttactggccccactacctggaatactttcctccagatgcccacctagataatggctgtgcctcctacatacctttgttcaagtgtgagctcctcgctggaccctatgtagccatatatgtatatgtgaaactgccatttgcttcctcctttctcactagaaagcaaactgcacttgggcaggcagcttggctgcttggtacacgtctgtatctgcagcacctaggacagtgccacatacacaagcactcaatatctagctgttaaacaaattaacggatgtgttaatagaatgccctgcacccatgcccttggaagtcgctcaggtgtccttctagagaccccttgtagaatgggcacatgaggcttggcagcccttgagctggttgggtgagcctaccacgtgttgcacctctgtggcaaaaacatcccacaagaatttctcttccacacttcaatttgccctgacactgggaagaagaatatgaatgcatccgctctgggaagacagaaagggaaggatcagaacaaagattttactactttttcagcagtagacaacgtttttttaagtaacatcttcagcctaatctcaaacaaaaggagataaaagtggtatagtattccccttctctgcagttttacttcttgataccgcagtcaactgaagttcaaaaatatgaaatggaacattccagaaacaaacaattcctaagttttaaattgtggacaattctgagtagcatggtgaaatctcaagccaccctgctccatcctgcctgcggaaataaaggatccctttgtctggagtattcacatgtctatgttccctgcctattagtcacttaggagccctctcagttatcagatcaaaaaaacatagcacacacagtgttcagtactatcagaaggttcaggcattccctgggggtcttggaacctatcccccgtagataagagagggactaccatattatgtcaaagtcatgctttaagtgcaaaattatactaagtcattagaaaaatgtgagaccaagtgactgctgagtcataacaccctcggtatccaagcatttctgtattttgttttggttgcctgcttttgaaaaaaacacaaatttataaaaattaatagttataaataagaccactttgaatctcagtaaattggcagtacaaattgaaatgacagcggacaccttattccgtactctataataaaccagggaggccaagtaatgtcacagtaaaagttaatttactgagtgaaggattctaaagtcttaaaattctgtacatggtatacatttttggtataagtgtttcttaaataatgggattaaagcaatataatatctcaaatctcagaagcacctctagaatctgagggttctgagtaacacagttggcaagtcactattttaaggaaccaaatttatctgataagaaattttggggctggacctggggtcagacagagaaaaacaaagtgatggaagatgagttccaatgaccctactcctgaacacgaatgaaccctgctgggatgatcttttgaaagaagaacattagagagagagaagaaaaacagtatcaaggacattataatatctggtataaaatttaaaaccatgattgtcagaccttgaagcatcaaacgactggtgcacttcaaaaatatttctaaggtaaggctcataagagccttacttcttggttgcagggttttacagaaattattttcatgaatgcaagtaggattggtttaaaaaatggtgcatcgtcaaatttgcaagactaaatgtagcgaaaaaaatcaaatcactggagggatggctatttttatacatgaatttcctaaaagtattagtataaggaacccaattcaaagtcaatcaagcagggataaaagtattgacatcggagtggattgaattcccaaggactggcttgcctagtttaatatttcccaaatgcatttggtggaaaattgattgcatctaatgttatattttctctcttttacaacatacaattatatcttacatcacatggatgatgccatccaagtaccacaatatctgtatactgttcaacagaaatgtttgctagcaattagatatatcacaagcaaattagaattagatgttttatctgatgtaacatttattctgcatatgtagagatattccaaaaggaataagttgattatagaaagttatgaaaaatgtcacaccaaccgagcttagtaagactatctgaagattgtatgggacaccaatatgaattcacaagataaaattttaaacaatatgagaagcagcatgttagcatgggattctctgtaaaaccttgaccaacactaggaaaacacaacttgatataatgaagcctgccttgaaaatacttttacaaggctaagtttgtggtgtggctttgaccaaatctttctttcacacgccagttaactactgacaataatattctagcactattggtaaaagtgaagattaaccatcctgtccctaaaacaaaaagaaatttcacagttatatgccaaggtttcatctgggaatatagttaaagggttcaaaagggactgcatgtagcaagtaagaagaagtaccaatctttttattttgaggcaacatgaaacagatgtagaaaacgacgccagcaaccacagcatgaatgcaaatgaaggtgcagaaaccacgcaactctttgttgtttggcttagaattttattttactgatgtgaatgaaatatttttatattttcaagaggaatatcccatttgtgattttgtgtgttagatttctcttgcttaaaatgtaaagccacctatattggcatcattggtttgagtcctattattgtgtattctggccaaatcttaatgaagacattctgtatgaactgtcagcctaatagccaatattgatgtaaatatatggatgtttgctttcagtttctccataaatcttttctatttttctagtcttctgaaactggcttcatgaaaacaaacaacacttcatacctgattactttctctagagttctgggttaatatctatgcactagactcactggagcacttacaaaacccagattatgaatgtttcctggggaattgttttatactcatggaacaactcagaatttattcattattcaagttaaaaatgcttgcttcctgagatatatcctatcaaagtcaacaaagattgactttacttccagcttgagaacatattgatctattttccagatctcaagatatatgcaaaaccctccttatgaaccttattcagcattatttccataagcttttgttttcagctacaaaaaaatgaacacgaaaatttgttttctagtgtaagtttggtagtcattgtttactctcattttaaataaaatgtgtaacaggataatatactctgttcaagaaacacattatttactatattatcacaatggtaaatgagcacttagtgaacatgactgatacattcatgtcctagttaatattgaacactctcataacttaatgaatatctgcttaaacgtattaaatcaaataaataatttagcattaaacagcaattgtgtggttttgccatttatttctccaaacatttttctctcttctataatttgttcatttacatgccagagatgtcctaaaatattgtcattactattattaagatgtttgataagagctccatctaagaaaaaagtccaaaagcatttcaagtgtgagaataagagttggtgaatttttaatgtctgtaacatctgggatatgttgatggaaaattgatgccttttgttataattttacaacaaaatgaagagaacatgaggcactccttcccttccatctatttaaatcattccttttgttatgtgattagccagggttggcaactaattgccaaatgttacaacttcactcaatttcctactaaaggaatttgattttgaaataaattaattgcctacaccaattagggccttgaaacacaactttgtgtatatctgagggtggagcattggagtaggatgaacactggtcccttaaaagatatccatcatcatctctgcaacctgtgaagttaactcatacggcaaaaaaaaaaaagaaaaaagaaaaggactgaagataattaaattaaggatcttgagatggagacattaatctattattcagggagcatctcaacatcactgaaaacattctcatatgaagcaggcagaggaagatgcggagcatacagaggagaaggaaatatgaccgtggaggcagagatagtgatgaaggagcctcaagtcaaggaggccggcagccacccgaagccaaaagagaaaaagaacaaattatttcccccaaacttctggagaaagtgtggcccgggggacccctttattttagtcgcataagaattaatttggactcctagcctccagaactgtgagagaaaaaatttctgttgctctaacccaccaagttcatgataatttgtcacagcagccatacaaaactaatacatacatacatacacatgaattacacacatgaacacagtcacactcaagcgagtttaggagcatggggtggacatgttagtatctgtgtgtccatctaccaaacatctgggccaggcccattgtacgaaattggaacatgtcatcccaaaatatgcctttgtcatgggattattttgagctgattattttgagaaagcctagacacaggagaagctctgaaaacagagtagaaattgtgtttgtgtaaggtaagcttacatctataaaggaaatctctatttgtaagggtgtctcccctactgtaccaggaagagaaatatgatcctggtcaggagataagtcaatggagaagccactgacttaaatgtgcacaacaaaccttactccggctaaccatgccatttctggtcacgttgccattacttacctctcccacacacttctttctttaatctagctgaagatggtatttaagcttgaattctaagatatctctttgagagtgactcatttccctgggtatctcccgtgtgtgtaagacataaacatatttttataacttgtttttctattgttaatatgtcttttgttacaagggcccagctgagaatttagaagagtagagggaaaattatttcttcctgccctacaatatatatgaaagatgtagttgttgatataaaagacctcttaaggaaaacatgctgtgatcttgggcgtcttgaaggggaacactcaacccagatgtagggatctggagatggatgaaggaacatttcttagggaggtcaaggcttgagctggatcttgaagcaattgaccagtgagtgaataagtggaagagtagatgttcaagaaaagcaaatgaataagctggtgcaaaggcctgaaatgggaagaaaggacatctaagctggagaactggaccccagggtggggattggagaggtctctggctacacgctgatatgcagctcaggacaggcctcctgaaccatgctaaaagaagttagttcagatttatttttcatgagttgaagaaaagccatgaataaaattttaagcaagatattggcatggtgagagacaagtagttgagaaagacttctctgtgggtataagacctggaaagcagtgtggctgtagtggtgaatacaaggagagtgatgtagaggtcattgcaggcaaccagcaggtaggcattgggaacctgaaattagcagggacaatagggatagaagaagggatgggtaaccagcaatttagtagtgggaagggcactgtcttttgatcatgtagatgtgtgggtggacagcagtagcacaagtctgcctaatctacagtatgaaactaattcccacccattccttaagctgggtttggactgaatgccacacacaattctgaactgctttctttccacccccataagtaactttaaccttagacaaataaaactacctatacgatcctgtttaaagaaaacacaataagacagtaaatcttccaaaatagcaaagtagttcaagaaaaaagaccgaattcatacaatgttttgatcatcacacttttaaatcaaacacactttagttcattggtaatacattctggatttttaaaacaaatggaaaaccaaccaaagaaaatcttatgaatcacatgaaagttacctttaaaactgtaggaattcaaagtaattcagtacaagaacttctttttcaaagtaatacaataatgatttatttgtttggaattctgtgtcctaagtcaagcaaataagatataaaaaattacacaaacataaatttcaaaatgagagaaaacttacaactcttgacttccaagacatttagcaaagctaaagaagttggaatttaaaagtggaaaaacataagaaaaatagactaacaaattaagattttcatatctattagtattacatttttcttagattttcacatgctatggttttaatgctccaccaaaatttatgttgaaatttaattgctgttgtaagtattaagaggtaagacctttaggggacaactaggtcttgagagctctgtcctactaaatgggactaatgccattgtctcaggagtgggttagttataactggagtgggtttctgagaaaaggataaatttgggctagtgttctccctctgtctcatgagctttcttcatatgatgccttccatactaggatgactctagtcagaagctggcaccaaactcttggacctcacagcctccagaaccatgagtcaaataacctaatattttatataaattacccagcctatggtaatctaacagcagaaaaagtgctagacatcacatctgagaaaaattctgaaaagagccatgctattaaatgctgatattaattgtctccaacctagaagagggagggcatttcttccttaatcagccaactttagaattcacactaaagtttcagctgtactgtgtctcaattataattcacaatatcaacagcaaaaattcaatgctattttctaaaaatactttaggtatgactctgatttctcaagttttgactatgactatgagtcatgactaccaacatttagatcagcactatgagattaaccagaaccaatatgtaaatgtatacggcagaaagccatcaatcaatctggagtggacacaatgtttccaagtgtaactataatagaggagcaaagcaaaaacagaatcctggaatcagacaatgtgtgacagtacaacagcctaaaagagctgccggcaagacatattgggaaagttagtccaaaggagcacatccatgctcaagagataagaatgaatcaactcctgatggggaagatggctggtactcttctgcccatcataactaactctaccctcccaacaatctagggtataggtaccagtattacattcatcttacacagtaggtagaaaggagcttaacaacttgccaaagattactgagcttttaaatggatggcctgggattatgaagtcaggccaccctggctggctccagggtccacaatcttaacccacgtgcgatggactctttcagtgaatgagttggcaggatctcccagattcctaattccttcctgtctcaccagagttctattgacagattgagtttgtttgctttgaacttgtcagacaaaataaaatgtggtgcttttgaaaggcccttggtgggaaagcggggaatgaaatggtttggctggagagagaacactactccacatcttcactactgagatttcaacccagttgttatgatttcagtgctgatttcacaaagtcatcgattcgaaagcttcccccattcccaccctgtaatctgaactctgaaagtacatggaaaacacaaaagtaaacttaattgtgaatagtcttattattctgcaattttgtgtaattatccaaacccacttgaaataataacagaggtcaagacaaagaacatgcacggataaacatggatattgttccataacctgacacattatatgtgggttaagatctttacactatacaaagaaaattcaaactgggttatatttcctaagcgagtttatacgttgaattaggagaatacagcaaaaactatcccatggagacattatgcaaactggtaagcatggaggtcatcaagccttatgtactggagatggtaggacagatccatccattattcaagcacagccaagaaagtgcacttgaagttccaatctaagattctaagattccatattcttcctttatggtaaaagatgggttccaagtttcccatatggaatataatggccaagccctttcttatacagctcagagcagggacaccctggggaggtgtgaagaaccgtggaagagatgaagatgagggcctagtgcactcttgggctctcacccttttgcatgggctagctccctgctttctgacctgctccctaccagaacacagctcttcctcatccccagcctcactatccccctactctcctctaattggagtatccacctcattagagtctccttaaatggtctcagggctgacaataacacaacaatttatggaagagctaaacattcctccctatgctatcacacaggcaatgggtaagtactgcattttaaatttagtgctttctaggacaatcataccccaaaagagctctaatatgtctgaaacaagtaatgctaacagagttgtctgcctcatttcctaatgcttcaagctcttattaggctgaataattaagaaaactattttttcttctttgtttttccaagtatgataactttcttccatacatgtctatataagcttttactcaaggacagctgatttaatgggttgtgatgacggataattaagtctcttaattattctcttaggattattgtagctgtgaaaatcaagccacatacacatacattcaaacagcaattaaaaatattgaattgctttttaatttagaaattatttctggttttggaagctatctctggccccaatatgctcatcattatatttgcatattcaaagactttatcagtcttcataaccattttgattggtctacctcctatggtgttttgacaaatattattataatctgttagatttatgttcctactaatacactatccaggtgatttaacaaacatatagtgtttcgttatccaattttaatagaacctataaaaatacaaatgtaactagtccaaatgtggtacaaaatctcatcctttcaagaaacctgaatctggttattaccaaaataattccttcctgtgccatctacaccagcctctactttccctttaaataatgatgagcctcaagagaaagaaactcaacattaggaaggagcttctatattgcctttacatgaataacaaacaaaactattatagcatgatcatcctaagataaaacagttaactttgctcctccatgcctaacatcattaaggacattccttgaggttcagtaatgtttaatatcaatagattcacaacatacaaaatagaaatagaaacattatcaactatataaaatcacttgattggttctctaccaagaaaatgccacaaaacaggaagtgttaactctccagtaatattcctacatagtcagtggaacttgtaaatgtattcaactaatatttactgagcacctattatgtaacagaatttgggatataatatgagcttttctaaagcctgctgtattttagaaattcccagcctagtaaaggcaagagaaaaaaagtaattgtaatacaagttgagaagtaaaggtatatactgtaagaacacagagagaaaaacacgtttgtagagaagatggaggattacacagcgatgcccagcccagcagccacctgagcaggaatgaagggaagatagaagttcttgagagataagagagacgtatgcttgctgaaaacaggtaccaggatgtgcaaagtctgtgagaagtggaaaaacatctcacattcatgaaactgcaagaaatgtgtatggctgaatgccacaaggaatgttgaggaataagcagatcttgaagctggaaaaacaggaaaggtcagaccatggtgtttcatacaggatattgtttgaaaataggattttttttttaaatttaagagttttaagcagtaaggtaatgccatagtttacatatattaagccatgaaccacagtaggaggcaggaggaatggaggacacagagcattataaacaactgcccaaggccagaaagcaagtaaaggagctaagattcaaatgtgatcagatgcgcagtttagaaggatgacttgaggaaaaagggatagaatgtatgtgaggatagaatacaattaataaaagattagctagtttaagcccgtggtgataaggcaacgaggctgaattcaataagcttgaataaggctgaatgcactgtaagctgtagactagacagaacagtataagtacacatttagggaccatcaatgagaacggggaaccagcaaaggcatccattgctctggacaaaaggttatgaatctgatctctgaggtcagtttaaagagctccatccaaatgatgatagtatgaaaaactattctactgttcaggaaagaagttagtttggaggtaaagacaaaacattccttatcttgatttttgtatgtctttgcttgggaacaaaggagatacagtgatgtaagtgtggctcagatgttttgtttattttgactttgcttcttttgaggggaaaggaatggaacaagaagtcacctacaattgctcacacaatcatccatctgcatttgtcatagctggtcaacatgcagggtccacaccaaggtgctgaccacattatgggtatgattaaggatgaggaccctcatgtgaaatagctttgttgagcgtgagaaacaatgtgccctaacacaaagacatacggcttgatcaccatgaagtggggatcacaacaattcactacagctctttttcctaaagaacagaacaaagtatccattatagcatttgacaatctaagcattccttctgggaccaccttctgcccatggctcatcctgtccaggttttcttcctcatcactagctgctccttctcagtctcctttagcagactaagctgtgtttcctccaatggtggcatggccctggcatctgcttcggatccttcactttccactcttccttcctccttgggtaatattaccttgttttatgacagcaaacaccatcagtacaacacacctgcattcctgtccattactggaaagtattaattcttccacctctctcctgggtatattccttggcatatccaaaagcatctcaaacgtaatacatgtaaatcaccagccatgatttccctctctgcctcccaacttgcttctcccctagtgttgcccatacactacccacttagttgctctggtcaaaggtatacaagtcatccttgagtcttcttgtttcctcactgccaacatccaatccaccaacaaatcatgttgactggaactaacaaacaaaactttccaaatgcgtccatttctctaccagtaactcttgcctaaattctaatgcaatttcctaatggatgtccttcctataactttgtcccattataaccctttcctctatgactcacccaaaagtatctttttaataagaaaaatagatgatgtttaataccttcgagtggcttgccatttaggtacctaaaacacaattcaaagtcttgggcctggttcacaaagcttgaggtgtttctgcctccaattctctgaccccgtgtgtcaccattcctctactccttgagccctgtgatccagcaactctaaacctctgtaggttcctttagccttatccactgttccctcttccaaacctttgtattcactgagctctctttcccaaaggtgctttccctcacctgtgcctgactcctcaatattcagatattgactcaactgccactctataagagtagaccattctttgccaccctatctacaagaacttcataaatactttctatcacatcactgcatttgaattcttggcagcacacttaccagtttctaacacttttcctaactattaattgattaaatatctcctccaactataataacactgtaagagaagtccttcccttggttcaacactttatttcctgtacttggaagtctgactgccccataagagaccctgattaaatatgtgctgaaggaaggaataatctaggagtttgaaatgagtttacttttgcaaacttctgtctgaaggtaggaatttcaaggcgagagcctcatcacatttgtcatcaggtgaacctggttttaagagtataagttcaagattagcatgaagagtgaaaaaatcagtttgcatttagttttcaaattcatcttgcatatctatgtgatgtgaataataatctctgaccttcttggttcataaaattgttgtgagatttaatgagatagttacagaggcactgtataaactctcaggcaaagtaatttagtagaaatagttgggtctgtagtcttctgtctgcatcaccaactggagagcttattcatggcatggaggaatttgctggtacattgagtgagtgtggcttaactggggcggtgggagttgccacctggcccttgaagagttttgcatctggcaataatccagagaatgactccactgagaggtaataaacacagagaaaactctttacctatcatctctatgaccttctcacagcgtcttgtattggagacatttcaattgttccttggatggaaagtagctcaccttttactgtcagcaggacacatggtacatgtgccattacgttgggaaatggctgcacaactattctaagtggaaaagtaaagctctacacatctgtatactacccacatagatcttttttttttccattctacattaaatgtcactgaaagtagatcaaatgaagtgcaagctcccatgtcatcctggaaaatgtccatgaaaacagtcagcattaacacaaaatgtgtggtttatactagggactgagattctattttgctctaaaaaaaaaagactataatttctcctgacagatgaggtcagtgaataatgtttaaaatagatgacgtccccttacttcttacccttccccttggtcataaggcaccactagtggttcagaacccccagcattacaaccaccattacatgcatcaaggtggtggtcagggcttgcagatgttttattacaactctaccaaggggcatccatgggagggttcagcaaagcccaggaacagggtacacaggggtgtgcagggcaagtcagcccctagacagctctgtacccagtaactgaggcctcagaaggcagagagaagccaagtaaagggcaaggagggtgttagggtgttttgtttccttccttcgaggctatagatgataccactacaccctacaactagctgccagcacctagtgcaaacatgctgagattttgacctgctgaatacacatttggactgaatactgaaaagtcgctgagaagaaacacaagggggaagaactgtcaaatggcatggcatattactaacataaaaaaagaagcattcctgttgatttgaaaagaatatcaagagaagctagaagccttaccatcgccccttcaaataggttatcaaatgctagcttcagtcctaactctatattttcatgtaagttcttaaattaagaggctcagggaaccaaaattttactatgcaatgaacatcttggccattgggttacaaatgaattgatcaaacttactttgtcttgggattggatttaggttacctattgaagactggtagccaaccaggcgtgctgtctttcagtgaggtggcaagagaccacaggcctatctcattctgtcttctccactcgcaggctcaaatgccaaggcctcaatgcactggctctctctctctccttaagtgtacaagacaatggaagaagtcttgccctaatcacccttaggttatccaggggaacaaagagctgggctgaatcctggtgatgagatttactcaagtctttttatttccctatccctcatttttcctcattgcttgctggatataataaaaatagcaacctcaaagggtcttggtgagtattaaggagtgcttacaaatagcatttaatccagtgtctgcacatagtaagcctgtgatattgttaactacataattacttccactattatttgtcttttcttctttctttctttttttttttttttttttttttttccctgagatggagttttgctctatagcccaggctggagtgcaatgtcatgatctctgctcactggaacctctgcctcctgggttcaagcgttcaagcaattctcgtgcctcagcctcccaagtacctgcaaccacaggggcctgccaccatacctggctaattttgtatttttggtagaggtggggtttcaccatgttggcgaggttagtctggaactcctgacctcgggtgatctgcctgccttggcctcccaaagtgctgggattacaggcatgagccaccaggcccggccccattattttttacaaaaagcctttttaatcccattctaattcttttgctatctgcctttcacttggaaatacagctacaatggaagagagaaatgcaaactgcttctgggcaaaatttgcttttaatattctcaaaaggtttgtagtaccaaatttttccccacatgttcacttgaaattattcttcactttgggggagatttaaaaataaaattttagtttccatgtagttgagtggctttgagtgagattcttaatcctgagttctagtttgattgcactgtggtctgagagatagtttgttataatttctgttcttttacatttgctgaggagagctttacttccaactatgtggtcaatcttggaataggtgtggtgtggtgctgaaaaaaatgtatattctgttgatttggggtggagagttctgtagatgtctattaggtctgcttggtgcagagctgagttcaattcctgggtatccttgttgactttctgtctccctgctcctgaatgactactgggtacataacgaaatgaaggcagaaataaagatgttctttgaaaccaatgagaacaaagacaccacataccagaatctctgggacgcattcaaagcagtgtgtagagggaaatttatagcactaaatgcctacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaatcaatgaatccaggagctggttttttgaaaggatcaacaaaattgatagaccgctagcaagactaataaagaaaaaaagagagaagaatcaaatagacacaataaaaaatgataaaggggatatcaccactgatcccacagaaatacaaactaccatcagagaatactacaaacacctctacgcaaataaactagaaaatctagaagaaatggatacattcctcgacatatacactctcccaagactaaaccaggaagaagttgaatctctgaatagaccaataacaggctctgaaattgtggcaataatcaatagtttaccaaccaaaaagagtccaggaccagatggattcacagccgaattctaccagaggtacaaggaggaactggtaccattccttctgaaactattccaatcaatagaaaaagagggaatcctccctaactcattttatgaggccagcgtcattctgataccaaagccgggcagagacacaaccaaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaatatacgcaaatcaataaatgtaatccagcatataaacagagccaaagacaaaaaccacatgattatctcaatagatgcagaaaaagcctttgacaaaattcaacaacccttcatgctaaaaactctcaataaattaggtattggtgggacgtatttcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaatcaggcaggagaaggaaataaagggcattcaattaggaaaagaggaagtcaaattgtccctgtttgcagacgacatgattgtttatctagaaaaccccatcgtctcagcccaaaatctccttaagctgataagcaacttcagcaaagtctcaggatacaaaatcaatgtacaaaaatcacaagcattcttatacaccaacaacagacaaacagagagccaaatcatgagtgaactcccattcacaattgcttcaaagagaataaaatacctaggaatccaacttacaagggatgtgaaggaactcttcaaggagaactacaaaccactgctcaaggaaataaaagaggacacaaacaaatggaagaacattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaaccaaaaaagagcccgcatcgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataatgccgcatatctgcaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagatttaaacgttagacctaaaaccataaaaaccctagaagaaaacctaggcattaccattcaggacataggcgtgggcaaggacttcatgtccaaaacaccaaaagcaatggcaacaaaagccaaaattgacaaatgggatctaattaaactcaagagcttctgcacagcaaaagaaactaccatcagagtgaacaggcaacctacaacatgggagaaaattttcgcaacctactcatctgacaaagggctaatatccagaatctacaatgaactcaaacaaatttacaagaaaaaaacaaacaaccccatcaaaaagtgggcgaaggacatgaacagacatttctcaaaagaagacatttatgcagccaaaaaacacatgaagaaatgctcatcatcactggccatcagagaaatgcaaatcaaaaccactatgagatatcatctcacaccagttagaatggcaatcattaaaaagtcaggaaacaacaggtgctggagaggatgtggagaaataggaactcttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcggcactattcacaatagcaaagacttggaaccaagccaaatgtccaacaatgatagactggattaagaaaatgtggcacatatacaccatggaatactatgcagccataaaaaatgatgagttcatgtcctttgtagggacatggatgaaactggaaaccatcattctcagtaaactatcgcaagaacaaaaaaccaaacaccgcatattctcactcataggtgggaattgaacaatgagatcacatggacacaggaaggggaatatcacactctggggactgtggtggggtcgggggaggggggagggatagcattgggagatatacctaatgctagatgacacgttagtgggtgcagcgcaccagcatggcacatgtatacatatgtaactaacctgcacaatgtgcacatgtaccctaaaacttagattataataaaaaaaaaaaattaaaaaaaaaaagaaaatatatttcttataaaataaaatattttcgaaaaaataaaaataaaaataaaattttaaataaatgcctaaggaattccaaatgatttggcaagctaaatccattctgtcaatagaaaaaaaaaaaaagatacagatgtctctgccaacaaaaaatcggttcagaatattaggttgtttattgcaatatttgtatttgaagaaacccacaatggttctgtgcattaagaatttttgagaatttgttatcattgaaagaaagaaaaattcccattccccattcttttttactccgtcctccaggtcatctaagtcaggggtccccaacacccaagccacggactggtcctggtccatggcctgttaggaaccaggccgcacagcatgaggtgagcagcagacaagtgagcgttactgcctgagttcctctgcctgtcagatcagcagtggcattagattctcttaggagcatgagccctattgtgaactgcgcactgcagtgagggatctaggttatctactctttatgggactctagtgcctgataatctgaggtggaacagtttcatcccaaaatcaacacccaccctttccccactgccccaatgctcgtggaaaaattgtcttccacgaaactggtctctggtgtcaagaagactggggaccactgatctaagtcgttagaactcttgtattctaccattcaacctttacctatgacatgaatttaggttcttgcaaaagaaagagaacataggttttcatgcctgtgattaaatgcctatgatctgtactttgccatgtgattccatggtgggaggcaagttatcctcatcgatcacatttagagtttaaccacatgagctactctaaagaagatgttctcatggctgagttttccctgtgtctcttgggtatttctcaatgtgcactgcatttagaaataaatctcaaagtgctctgatgacgtatcttttctcaaacacacattcccctcatctctccccatctcccctgcagaaattgataagaagtgaatttctctagaaaatctagttttgttgttgccattaaactaattttaggattggaaactcacatatatggtcactatgtgcctaccttctttttaggaaacatgagtctgtgatgaaagatataagtgaatccaaattcaagtttaattttggaaaccatatggtaagataagaagagaataaaacatagccttcaaatagatcacattagttttcatttagacctattatttactatttaagaacattttacatttgccaaatacatttctataagccaagaagaaccaaatttttagagctagaataaagacagaaaaaagcaggagcccagaaggaggaaaagaaaggaaaaagaaggccaggaaggtgagggaaagtgggaatagtcaaaggaaagaggatggcaaggacaaagaggaagtgaaaaaaacattaaaccatctaggctccaagtaaataacgcattttatttcaatatgtcaaagcaaatcctagaataacgtaccaggcacttgaaattaaaatacagccatatgctccgggaatgattttacaaagaaatgaaggcagaactgatgtcagctgaaccacttgagaagaaaatgccctacagttctcagcttcggggttccaggttgctgggggtgtggcattctcatagtgacacctcccaccctgaggtcatagtgacacctcccaccctgaggtcaccagcgggttaatgttcagtttgcccttggtagatcctggcaaccaggaatggcaacataaaaaaggaagcacatctctgttttataattttatgtatcatatttgaggacaaaaatatatctttccaagtaaaatgaatctagttcttaagtaacaacaacattcatcactctcaaaagtgtgaggggctggctgacttcggggtgggaagaaacatggggcgagggtgcagtggggaagaatcaagtttctttacctactaagtacattatcccttgtttcaaaccccaaagacgtgaacagagattgactttgatctgaaattccttctaatcttactttgggagccttcattataatgcacatgcatttaggaataaaagttagggaaaattcttactatgtggattgaatgactgaaactgtgagtgaatggtctgttgtggatgaaataaggacattccccatagccccaaaccaccgcgagacattttggtgtgagagtaaaattcagctccacggtcgtgtgctagctcagcatctgggaggaaccaggagggtctccaacggcctaattacatattcccctcctgaggctcctcttgtggatgaggtgctctagacaaataacctccttattagaaggacaggcccagttcctgcctatccatgaggtgtgggcttcagctccctaccagaccatataatttatctaacaagtcaatcccatccttctatggaaaccacaggcatcctaccttccttccactgtaaggcctgcctcccacagccctgtgatgttcaactcttctgccgcgggactcccatgtggctttgtgtggtgtgtgcggtcctcctgctccaggctgtgagtatatgtgactcataaactgctgctgatctcatctgtccagtgcctggcgtcccatgttcagctatccccataactctagggcaagggatccctccctcacgaataagacaaacaaaaggaaattaaaacaagcaacttctgaggtctgctaaaccaagttcaagtgagctgtccacttagcgtctgtttaggccactgcaaggctgctttctccctaccctgcaagtctgggttccagacacaggattcagcaagccctggctggctctccagcaggcgctcttgagaatgttaagggctcagcaggcacaccgtgttttcatgttcagggcctggcatctgaaaaatgctaggcggagaagggcagtgttttgcggaggaagaccaaagagtaattgctacatttcaacattccttgccccacggctgccctgcttccaaatctctcccacattttctcccacttaccgcgaaaaaatccatttatctcacatttcccaatctgtttgtgaacaaaaggcatccgtcctcaatgccgcactgtatgagctccaaatactgctggtgctacgtctgccttgagggcattttaggagagcagggaatggttcgagtctctgaatacaggttgatgtttccaaaggagagaacagtctatccatggttctgtgttttagtttgatatatcagataacacaagatgccagagttatccagggcacattttaaagcacaagtgagcttctgtgctaagtatcttataaatagagtcttctggcaaacttctgcttttaaatactattattaatgagaatgaatggaaataaatgatctggagggtttcctgttattcgtgacaatctttagagggccatggctccttaaatgacgagatactacacattttaaaagtctctatcaatctaatgataaaatgctaagttgaatacaccattattatttaatgtaatttcaggctaaattagaaacttttatctggtcccgtaagatagtgttagaaaacaatattttatcttctaagcaacttcttctcaccctcatgagaaagaatgtaggaagattatagcaatgaaataattataactattctcttttgatgggacaaagtaagcatgattaacttatttatcctacagtaataaaggtaacttgtccagctcagaaagcccatgaaactctagccaacttgtggccagaccctgtgtaactcactactgaaccccaagttcagactgctgaataaatcaatacaaactcaactttaccaaagcagtatcaatatggaaagttcagcaagctctggatattggaagagtaaatatgaacacctaatacaaaatacctaactaggtacaaaatgaaggagagagattttaagtatgcacctaatttaattctcagaagactcccttaaaatcccattgtacagattagaagcctgagattcagtgaagacgtgatataccttacagagctctgcccagctagaaagtagcagaatcaaggtggatttctaggttgctggctcaaaaccttcgaacagctctctgagtccacattgcaaacagcaggatgaggctcttacctgatgttcacattcagaaaagattagattcttatttaatatatgagccaggaagaatttcagctgagaagcccgccacactttgcaggcttctgggtttggaaaaactcacaacataaaatctcatctgaatctcctgtactttgcctctatatcgcgctatcaagctgttgcccgatccacttgaaaactctgctgagctgaaaccatcaattccttgtgacagttcattgaatctttggtccactttactttaggaagttcttccttaaactgagtgacatcaatcaccccataccttgtactctttagttctgggtctatgccttaatgacacagagataaattcttaactggtttccacattattgtgcttttcttatttacagaccctgaaatcttcctcctgggtcttctagaccagtgtttctgaaagagagtattccttctctcatttctcagataaaaggcatctgattcctctgactgccctggtctctttcttcactcttctttctgattagctagacctcaaaagtatagaattcaactaaaatagttaaagataaaaagacacatctgagatcgacttcagaatcatctctggccggggtgggcatgggcgaagtggataaggaaagagatgagaaaagatttacagaacacgtggataactttttaaattggcagctgggtacaaagggttttattatactattctctttacctttgtctatgattgaaatttttcatgataaaaagcttttttcaaaagtgtagcatgcaaaaacatgcatatgacaggatctgttagaggaagctaagttatcacatcctgtatcataataatataaattgagtaataaaaatatgattaaaaatttgagccatgtaaatatgctaatttgtgccttctgaaacacctatagtattggttatacctatagtagttggttcttgttgttcttgtaggtagtgcatttagcacaattgtagggcttcttatttgcccttgaaaattttttattggtagatttcatctgttaagaatctatggaccctaaagctgtcaatcagctgattcacttgggatgatcctcaaatatttttaacacatcgataaaaatacagagacaggctgagtttagaaacctagagaatcaacttccaagacattttctgtgtgtggaagatgtgcacagctagcagttcagtctggaaggatgactgaacaaacagtgataagaccacccattcactgaggaaaacacagaaaacggcgtcatgagactcccagggaaggaaatgtaaagcttactttttatccttttttggcaacacagttcagaatttttcagtaaatagtaatgtgatagcactgatctggaatttgaataaagctaaattatgatggaactaaaaatgccatcttaataaatactactgcccccaggccataagagttgatacagaggtaggaaatattgaatccataagtgagcaaaagataattagatgttaataaagaatttattttccccgcactgtggcaaatttcatttacatcacacttcataaataatcaccttcaacacttcaacagattgctgtaatttatcataaatttttaaaatgctaccttgtatatatataattaatcagcaccaactgcttgaatttgtaattgcttaataatttggggataaattattatctgtgttttaaacatactaatttatttttaaagtaagtatatttctatttgttttagaaatgatgacaatttccagatcaagagctaggaaggcatacaacatttacatcgtacaattaccttctggatgctaaggacaaaacacatttttgtttctccaggttgcaagatctataggctgatagaaatgcatccctctgcaacaacacacagcacatgtggtgggggaatgaactgagagaaaatccgcgggatggagactgggagcctcatgcctctaatttgtcatcacgctgaatcatccaacatcctcacctacaacaaattactgagactagcaccctgcttactcccttccccagctctgtgagagacaccttggcgccagatggcaggcaggagatggccaggcagataatacaggatctcctgtaggcatggaagcagtagaaatagatattaataataatcacctattgtgttggagctgtgacttgtatctgactcagtagaaagacaatggagatggctatggaattcctaaaaagtacaagaacagtatttgtgttctggcttggttttgattagctatgcaaccttgagcaaatggcctcacctgtctaagttagcgtactcacttgaaaatatggggagaaaataataaatgccctaattaccaaaaaatggtgaggtagagcttgaaggagataatgttcatgaaaatattcttgttaacactaaaatagaatagaaacattgtaattacaactgctgttgtaagagtagcaaaagagacataaaatataaaatgtaagattatacatggtggtgaccttaaggcttctataaatttttataaaatatctatttatattctctatgtctatatacatagtatgaaatgtaataaatctgcatatgcaaaacataagaattagttctaacactcacttctgagttaggaagccagtgttattaaattccgtatgacaatgaactccatccagtcccctttttacagctgcacagagaagacttagtagagtaggcctgagactgtcatcctagaagggcctgcttgcaaaattggccccttagctggtttctgggagctcagatatcaggagggtttccacaattccctgttaaaaacggctcactgtgcctcaattattaatacatgcaaggtggtttacgcaagcatctgctttccttccaggagtctgcaattttaatacattccaggcagagaggtcctgtgtgatctgcccgcaggagaaacccagggcattgagcctctctggtagacaacactctcctcgtgttgtcacaatttgctgatggaaggattaagtgcatccagtgtgattccactggaagaagactcttggaagatcacaccttgttttcttcatgatctatccatgcacctcttgtctttgctaatttttttttccttcactgtaataaatcacagccatgcatgactacatattgagtccttgagtcccggagaattattgaacctggggtgatctacgagaacctcaattcaatagcattacaaatctatatggaaatgacaattttcagagatagatgacccaaaacttgagcaagtcccataggaaacaataacaactctttctagattctggccagaaaaggaagtatgaaaggtactgagagcgggggaaagtcgagtctggttggaaacacagcattcactttgggagcacattctcaggttgcctgagaactgactagagatgcttccaatatacctagaaagcagcagcccagatttggcatactctgatgttggggcagcgggtgggggcagggggaggagggtttccccaggacaaggttaaggagctttgctttacctggaacttctggtcaaaaaagaaaaaaaaatagattaaatataagccataatgttattgagatctaagaggcagacttctccaatgtacatcagagtagcaaactacagcctgtgggtcaaatccagcccattgcctattttctgatcacttgcttgctaaaaataggttttatattttcacatattgaagaaagaatttgtgaatgtttgctttctcctttttaacataaggaacttgatacggttttgttctctgtccccacccaaatctcacgttaaattgtaacctccacatatcggggaggggcctggtgggaggtctttggatcatagtgacagatttcccccatgctgttctcctgatagtgactgaattctcatgagatctgatggtttaaaagcatgtggcactcccccgtttacttgctctctcttctgctcctccatggtaaaacgtgcttgcttaccctttgccttccaccataattgtaagtttcctgaggcctccaggccatgcttcctgttaagcctgtgaaactgtgagtccattaaatctcttttcttcataaattacccattctcaggtagttctttatagcactatgagaatgaactaataaagaaaattggtaacaggagtgaggtacggctataaacataactgaaaatgtgaaagcgactttggaactgagtaacagttaggggctagaacagtttggagggcacagaagaagataggaaaatgtggaaaaatttagaacttgctagagacttactgaatggtttttgaccaaaaggctgatagtaataaaaacaaagaaggggactgctggcaagatggcagaataggaactgcagctcccagcaagatcaatgcagaaggtgggtgatttctgctttcccaactgaggtacctagtgcatctcattgggacttgttggacagtgggtgcaacccaaggagggcaagccaaagcagggtggggcatcacttcacccgggaagcacaatgggtcagggaactccctctagccaagggaagccattagggattgtaccatgcactccggcccagatactgcacttttctcacgctcttcacaacccacagaccaggagattccctccagtgcccacactaccaggaccctggggttccagcacaaaactgggcggctgtttgagcagataccaagctagccacaggagttgttttttcataccccagtggcacctggagcaccagcgagacagaatcattcactcccctggaaagggggctgaagcctgggagccaagtggtctggcttggcaggtttcaaccccacagagctcagcaacctaagatctactggctggaaattttcactgctagcacagctgtctgagctagatgtgggacgctggagcttggtgggggtgtaggggagtgtctgccattgcttaggcttgagtaggtggttttaccctcacagtgtaaacaaagccactgggaagttcgaactgagtggagcccaccaccgcagctcagcaaggccactgaagccagaccatctctcctctctgggcagggcatctctgaaaaacatgcagcagccccagtcagggacttatagataaaacccccacctccctgggacagagcacctgggggaaggggaggtttttggcagagcttcagcaggctgaaacatccctgcctgatggctctgaagagaacagagatctcccagcacagcatttgagctctgataagggacagactgcctccttaagtgggtccctgatcccggtgtatcgtgaatgtgagacacctcccagtaggggccgacagacacctcatacaggagagctctggctggcatctggtgggtgcccctgtgggacaaagcttccagaggaaggaacaggcagcaatctttgctattctgcagccttcgctggtgatacccaggcaaacagggtctggagtggacctccagcaaactccaacacgcctgcagaagaggggcctgaatgttagaaggaacactaacaaacaaaggaatggtatcaacatcaaccaaaaggatgcccactcagagacaccagccaaaggtcactgacttcaaagaccaaaggtagataaatccacgaagatgggggaaaccagtgcaaaaatactaaaaattccaaaaaccagaatgcctcttctccaaaggttcacaactcctcaccagcaagggaacaaaactggacggagaatgagtttgatgaattgacagaagtaggcttcagaaggtgggtaataacaaactcctctaaggtaaaggagcatgttctaacccaatgcaaggaagctaagaaccttgaaaaaagttcttgaaagttagagaagaacataaatgatctgatggagctgaaaaacacagcaagagaaattcgtgaagcatacacaagtatcaatagctgaatcaattaagcagaagaaaggatatcagagattgaagatcaactcaatgaaataaaggtgaagacaagattagagaaaaaagaagtgaaaagaaatgaacaaagcccccaagaaatatgggactatgtgaaaagactaaatctatgtttgattgggctaccttaaagtgacaaggagaatgaaatcaagttggaaaacactctgcaggatattatctaggagaacttccccaacctagcaaggcaggccaacattcaaattcaggaaatacagagaacaccacaaagatactcctcgaaaagagcaaccccaagacacataaatgtcagattcaccaaggtcaaaatgaaggaaaaaatattaaaggcagccaagagagaaaggtcaggttacccacaaagggaatcccatcagactaacagcagatctcgcagcagaaactctacaagccagaaggagtgggggccaatattcaacattcataaagaaaagaattttcaacccagaatttcatatccagccaaactaagcttcataagtgaatgagaaataaaatcctttacagacaagcaaatgctgagagattttgtcaccaccaggcctgccctacaagagctcctgaaggaagcactaaacatggaaaggaacaaccagtaccagccactgcaaaaacataccaaattgtaaagaccattgatgctatgaagaaacggcctcaactaacgggcaaaataaccagctagcatcataatgacaggatcaaattcacacataacaatattaaccttaaatgtaaatgggttaaatgccccaattaaaagacaaagactggcaaattggataaagagtcaagacccatcggtgtgctgtattcaggagacccatctcatgtgcaaagacacacataggctcaaaataaagggatggaggaaaatttaccaagcaaatggacagcaaaaataaagcaggggttgcaatgctagtctctgataaaaacagactttaaaccaataaagatcaaaagagacaaggacattacataatagtaaagggatcaatgcaacaagaaaagctaattatcctaaatatatatacatgcaatacaggagcacccagattcataaagcaagttcttagagacctacaaagagacttagactcctacacgatagtgggatattttaacaccccacagtcaatattagatcaatgagacagaaaattaccaaggatatccaggacttgaactcagctctggaccaagtggacctaatagacatctacagaactctccacaccaaatcaacagaatatacattattttcagcaccatatcacacttattctaaaattgaccacgtaagtggatgtaaaacactcctcagcaaatgcaaaagaatggaaatcataaaaaactgtctctcagaccacagtgcaatcaaattagaactcaggattaagaaacgcactcaaaaccacacaactacatggaaagtgaacaacctgctcctgaatgaccactgggtaaataacgaaatgatggcagaaataaagatgttctttgaaaccaatgagaacaaagacacaatgtaccagaatctctgggacacatttaaagcagtgggtagagggaaatttatggcactaaatgcccaaaagagaaagcaggaaagatctaaaatcaacacacttacatcaaaattaatagaactagagaagcaagagcaaacacattcaaaagccagcagaaggcaagaaataactaagatcagagcagagctgaaggagacagacacatgaaaacccctcaaaaaaatcaatgaatccaggagctggtttattgaaaagatcaacaaaatagatagacttctagccagactaataaagaaaaaaagagagaagaatcaagtagatgcaataaaaaatgataaagggtatatcactaccgatcccacagaaatgcaaactaccatcagaaaatattataatcacctctactcaaataaactagaaaatctagaagaaatggaaaagttcctggacacatacaccctcccaagactaaaccaggaagaagtcgaatccttgagtagaccaataacaagttctaaaattgaggcagcaattaataacctaccaaccaaaaaaagtccgggaccagatggactcccagcctaattataccaaaggtacaaagagaagctggtaccattccttctaaaactattcaaaacaatagaaaaagagggaatcctccctaactcatttcatgaggccagcatcatcctaataccaaaacctgcagagacacaataaaaaaaaaggaaaatttcaggccaatatccctgatgatcatcgatgtgaaaatcctcaataaaatactggcaaaccaaatccagcagcacatcaaaaagcttgtccaccacaatcaagtcagcttcatcccagggatgcagtctggttcaacatacacaaatcagtcaaggtaatccatcacataaacaaaaccaatgagaaaaaacacatgattatctcaatagatacagaaaaggccttcaacaaaattcaacaatgttcatgctaaaaactttcaataaactaggtattgatggaacatatctcaaataataagagctatttatgacaaacccacagccaacatcatactgaatgggcgaaaaactggcacaagacagggatgccctctctcaccactccaactcaacataatattggaagttctggccagggcaatcaggcaagagaaagaaataaaggttattcaattaggaaaacaggaagtcaaattgtctctgtttgcagatgatatgattgcatatttagaaaatcccatcatctcagcccaaaatctccttaagctgataagcaacttcagcaaagtctcaggatacaaaatcaatgtgcaaaaatcacaagcattcctatacaccaataacagacaaacagagagccacatcatgagtgaactcccattcacaattgctacaaagaataaaatacctaggaatacaacttacaatggatgtgaagggcctcttcaaggggaacaacaaaccactgctcaaggaaataagagaggacacaaacaaatggaaaaacattccatgctcatggataggaagaatcaatattgtgaaaatggccatactgcccaaagtaatttatagatttaaagctattcccatcaagctaccattgactttcctcacagaattggaaaaatctactttaaatttcatatggaaccaaaaaagagcccacataaccaagacaatcctaagcaaaaagaacaaagctggaggcaacactggagttacctgaattcaaactataatacaaggctacagtaaaacagtatggtactggtaccaaaacacatatatatataccaatggaacagaacaaaggcctcagaaatatcaccacacatttacaaccatctgatctttgacaaacctgccaacaacaaacaatggggaaaggattccctctttaataaatggtgttgggaaaactggctagccatgtgcagaaaactgaaactggatcccttccttacaccttatacaaaaattaacccaacatatattaaacacttaaacataagacctaaaaccataaaaaccctagaagaaaacctaggcaataccatgcaggacataggcatgggcaaagacttcatgactaaaacaccaaaagcaatggcaacaaaagccaaaagagacaaatgggatctaattaaactaaagagcttctgcacagcaaaagaaactatcatcagagtgaacaggcaacccaaagaaagggagaaaatttttgcaatctatccatctgacaaagggctaatttccagaatctacaaagaactcaaacaaatttacacggaaaaaaacaaacaaccccatcaaaaagtgggcaaaggatatgaacagacacttctcaaaagaagacatttatgccaccaacaaacatatgaaaaaaatgctcatcatcactggccattagagtaatgcaaatcaaaaccacaatgagataacatgtcatgccagttagaatggtgatcattaaaaagtcaggaaacaacagatgctggagaggatgttgagaaataggaatgcttttacactgttggtgagagtgtaaattagttcaacaatggtggaggacagtgtggcaattcctgaaggatctagaactagaaataccatttgacccagcaatctcatcactgggtatatagccaaaggattataaatcattctactataaagacacatgcacacatatatttattgtggcactgttcacaatagcaaagacttggaacctactcaaatgcccatcaatgatagactggataaagaaaatgtggcacatatacaccatggaatactatgaagccatataaaaggatgagttcctgtcctgtacagggacatggatgatgctggaaaccatcattctcagtaaactaacacaagaacagaaaaccaaacaccacatgttctcactcataagtgggagttgaacaatgagaacacatggacacagggaggggaatatcacgcactgtcaggggggtgcggggctaggggagggatagcattaggagaaattcctaatgtagatgataggttgatgggtgcagcaaaccaccgtggcacgtgtatatgtatgtaacagacttgcatgttccgcacatgtaccccagaacttaaagtataataataaaaaagaacacatctagtagagacagtattgacttatcaatagacccagaaaaaatgtttaaattaaattttggagatgtgtttattttactttatcagtagttttaaaatcagccgtatttactaaatgttattaaagtcatgtaaacttaaaaaaaaaaaaaaagaagtcccagctgatgaggtctcagctggtaatgaggaacatactgggaagtggagtgatggcaacccttgctatgcttaagcaaagagactggtgacattttgttcctgccctagagatctgtggaactttgaacttgagagagattacttagggtatctggtggaagacatttctaagcagcaaagcattcaagaggtgatctgattgtttctaaaagtgtatgttcatatgcatgaacaaagagattatctgaaattggaacttaaaaggaaagcaaagcataaaagtttggaaaatttgcagtatggccatgtcgtagaaaagaaaaacccattttctggggagaaaaatcaagcctgctgcagaaatgtgcataagtaaagaacagctaaatgttaatcaccaaggcaatggggaatatatctccagagcatttcagagaccttcagggaagccctctcatcacaggcctgcaggtctaggagggaaaaatggttttgtgggcgaggcccagggccctgctgctctgtgcagcctcagaacacagtgccctgtatcacacatgccccagctccagctatggctaaaggggccaaggtacagctcaggctgaggcttcagagggtgcaagccccaagcctcagtagcatctacgtggtgctgggcctgcaggtgcacagaaggtgagagttgaggtttgggaacctccacctagatttcagaagatgtatgtaaacaccttgatgtccaggcagaagtctgctgcaggggtggacccctcatggggaacctacagtagggcagtgcagagtgggaatgtggggttggagccccagtatggactccccattggaacactgcctagtggagctggcagaagagggccaccatcctccagaccgtagaattatagatccaccaacaacttgcactgtgtgtctggaaaacccacaggaactcaacgccagcccatgaaagcagccaaggggcgtgtaccctgcaaagccacaggggcagagctgccaaaggccttgggagtccagcccttgtgttagtgtggcctggatgcaagacatagagtcaaaggagattattttggagctttaagattgaatgatggccctgctgggttttggacttgcatgggacctctagaccctttgttttggccaatttctcccatttgggatgtgaatatttgcccaatgcctgtacccctactgtttcttggaagtaactaacttggtgttgattttacaggatcataggtggaagggacttggcttgtgtcagatgtgactttggacctggatttttgagttaatgctagaatgagataagagtatgggggattgttgggaagccctgattgttttggaaatgtgaaaaggacataagatttgggaggggctggggcagaatgatatggcttagctctgtgtcccacccaaacttcatgttgaattataatccctgcatgtcagtggaggggcctagtggaaggtgattggatcacaggggcagatttcccccttgctgttctcatgatagtgagtgagttctcatgagatctgatggtttaacaacatgtggcacttcccccttgactctccctctctctctctctcctgcccaccatggaaagacatgcttgctttccctttgccttttgccatgattgtaagtttcctgaggcctccaagccatgcttcctgttaagcccatggaactatgagtcaattaaacctcttttcttcataaattacccagcctcagtctcaggtagttcttgacagcagtgtaataactgactaatatcaacttgcatatgaccattttgtcactggctaaaatattaactatccagccctttccaagaaagaggtgactgaaccctgatgcagaatgatgagtgtctgagggacaggattttagagcaatttcttttaacatgtattttttcttggaggaattccatcctaggagtaggaaaaaaataccgatgtcaaaagcaaatctaataccagggctttgtacactgacagatccaggatccctaattacagattctgatttttactttacatttactgcagcagatatctctgtattcaacagattccatttgttaataaatggaccaatcactacaaaaagcacatgatccctattgatcttgtcaatgaataatagaaaagtaaagaaaagaaaggcaaagatgaaagtgggaaaggtccttcaagaccacctgagcagcatcattcttcacaggtgagaaagtgaagcacatctggacacaggacttggcccaggtcacacagcccttgcagaaccaggactccctcagcctgaccccgtgttagtgcctatgtccctcaacaggaccagggttactattcataggagaagctctcacttggccagcctcaaattatatcaaggatgacaatctaaaaatgacatttgaagtccagtttcctacattaaaaatatgcagtgttcaatacttcagttattttggtacataggcaaattggatacctctgaaattaacagaaacaagaatttgaaaaaccaaccaaaatttttacatggaggactctcaagttaaccaggcttgctaagatgagaacatcactgacaacagcaatactcacccaattgtcttcctcagacctggaaggaaattgttccaattatgaataaaatgtaacgttttagcaaataacaataaataattgtatgtgtatgtgtatctgtgtgtatacaatttaaataattcctccgttaatttaacccaattcttcattaataatattagcatgaattaagaacttctaggcttgagaaaaaccactttaaaagtctcatttaagcttcataataaccctatgagttacaaaccattatcattcttactttatagatgagaaaccaaatatatttatattactgaattaagatgagttatcagaatttcatttctaatatttaatgatcctggtaggatggaaaatacacaaaaatgatacatcagttactgtactttgataatgtatctttacttctataggaataaaatttccattttccctctagcacagaatttttctcttctataatgtaaataccttcacttcatgcaaatacctaattcaatccagccaagaactcccatccaaaatgttttccctataatttttgtatatatttataacagtggtccccaaatagggatagttttgcccccccaggggacattcagcagtgtctggagacagctgggaagggtttgctactggcgtctagtggatagagtccaggatgctgctaaatgtcctatgctgcccagggcagcctacacaacagtgaattatctagcgtaaaaagtcaactgtgccaagacggagaaaccctagtttatatgaaaagcaaatcccatatccatattattttattgattatctcttgacttatggactaacagggttcttcagggacaatgagaattatctggattcttatagacccccagatcaccaaatagggtaaggcaaatcgggtaaggcaaatcatacaaactgattaacaggaaccaagagatactgctgtccaagaccggggagaagacggcatgctgtgactaatggacatcagtcaataatttcataacctctttgggatacaggcactttttttttttttttttttgagacagagccttgctctgtcacccaggctggagtgcagtggtgcaatcttggctcactgcaacctctgctgcctgggttctgcctcagcctgtcacgtagctgggattacaggcacttgccaccacgcccagctaatttttgtatttttagtagagacagggttttaccatcttggccaggctggtcttgaactcctgacctcgtgatccacccatcagagcctcctaaagtgctgggattacagacgtgagccaccgtgcccagcccaggcaccttttaagtaaagcgagagacagttcagtcctcgtttccttccacctttaacacaagagcatcatggcagattagttcaaatcttggagcaaaaatatgaaggccaaacacttaaaaaatgaataaaaataaaattacaaaaacacaccaaatagaagaaagcaaaatttaaaacaaatgaagcaaagaggaagttgattggaaagacatgaggccaaaactgattcaagcggtgagtcctgtgaacatgggtatgggccacatatttgtctctgcggttttcagtaatgaaagagaagaggatgtgggatttctaaaggcagaatcctggaaaagcaataacttgcccattcctaaaactttcaaccaatgtaatgcacatgtacaaaatgacacactcctctctgaaaaatgaatattaaggaaaatgagcattatatgacgtatatttatacctaaatcctaaatactttttctagaaaataagaaaaaaacagtataatctcagaggttcacggaggcatcatgcactttctggcagttgtagctgaccagacggataaagggacccccaaacagccgcctcccgtgtcatcagattgctctaaaatacgtaattccatcttctcacatgtgcacctccccatcccacagcatcaatcctaaattcctagtggtaggcaaagtagagtcccactttctaatccttaaaacctgtgaccatgttatgcttcatggcaagggggaaagtttagattgctggcagaatgaaggctgttaatcgattgagccatgacaatcaggtagcttgtagaagctggaaaaggcaaggaacctgactctccatagaagagcctccaagagggaaccagacctgccaacaccctggcctaagcacagtaagaccaattttgaacttctggcatccaaaacggtaagataatcaatgtgcattgttttaagccactgagtataggataatttgttgcagcagtatcacaaaactgatacaactcgttttagtttccttttgctgtctaataaattgccataaacctagagccctgaagcaatacctatgaattatctctcagttctcatgagtcaggagtccattcgtggtttaaccagatcctctgtttagaagctcattgtcctgacactgagatgtctttttaggcttgtgagagtcttctaaactcattggttgctggaaaaattcagttctttgtgactgtaggactgagacctcttgatactagggaatgcccacccctgtctgccctgtggttctctccacaacatggaattttgcttcttcaaagacaacagaagggcacctgctgtggcccttttaaagacttgcctgttaggtcaaatccactcaggatgatctcccttttgactaacctatactcaactgattagggttcttaattccatctgtaaaatccccttactcttaccatataaggtaaattaattatggtcctgctcacattcaaggggaggggatgatatagggtaggtccaccagggggcagaatcctggggccatcttagaattccacctaccacactccttggctgggcaaagtagctactgtaccagtttgcctctgcccgttaatttttaaccaaatgccccaacacaggcaagttagtaaggtttgtccactgtcctggacatgttcagtattagatacatagaacatatgcaaatgctagcatgttcctctctctccagtgactgttcccaaacttcaccttattttcatgattgcaggacataacacagaacccgaggtacatggacttaatcactgtacatctccacgcatgtgatacatggtcttactaaaaaatagatagatagatagatagataacagataataggcagatgatagataacagatgataaataaatatcaaatgatagataacagatgatagatgatagataacaggtaatagatagatagatattagagagagagagagagagagagagagataagagatagatgctgtctgtgccaaatttttttcttgattgaatactctaattccaaattaggagattgcttgatcaatttccctgccaatcattcctccacaggtaggcaatcaagggttccaaatgaaagcatatcataatgaatatctaacacagtagcaatttgcagtagactataaaacagtagctaatacagaattctgagagaaactaatagtgacaaggagaaagcaaaagaccttcagtttcataatgtaaactcaaactcagatttgcttgcctgaaaagtatcaatgtaggcacatcctgaatgaattatgtagagaaggcaaccgtttgggagttaacaatgagccagcatataaggaaagatggcaacataattacttccattccttttctataatggattgggctgattcaaattcaacatatttcatcaattttttttttaacaatcacaagtgatggtatttttccctttatttgctaactcagtaattcttttggggggtaaaattttgaggaaatcacaaatgaaacaaaatccctgatcatgggctaatgcagacctaagatgtttttgtataaaattaagaacagccttcgtatttcttcttgcagtttttagctggaagaagcctaccagcacaaaaaggataagctttaataaatagctctccttgtgataatgtagcacacattgcttcaattatagttctattctagtactgggggagggaaggatccgtcctggcagccagaaccctgcccaagaaaatgtgatgataacacaggaagggggcacccccttagccagccagataaactctaccagtctgaggcagacttcccagcaagaaaattctcacatcctcctattctaataatagaaccaaactagaggaagggaggaagaaacatctgtagttgtgtgctaaattcctcaagcctcctacactttttgagtcccctccctttaattagaagcatttatgcgtcattccacagtctctttttccttccaactatcgtctagtatgtcttctactctacaaatgatttctaacatttcttgttacaaaatgttcctgtgtggaaaatgctaatatttcatgatgcaactgacccaactccacagtgcagtgtaggattctgcaaacaccatcttgttattctccgtaaatatccccctttccttcttctggagaaaatctcaagcttcaatcactgggccgtgaacccgccaagacagtggcctttgagtcagtttgaaagaacaaaaatgcctagagcccttcctccccaaagaaacatgggattgacaagaaactctttagtctctcaacatactaacatacaaattaaacacattgtttaacacaaactatacttgccccattaaaactatcagtcaaaagactcagaactagccaggcttggttcttctccaagccagacttaaacaccagctcacaagttcccacaacatctgtttctagatgcttgatctatctccctgccaatcattcctccacaggcaggcaaaggtgccttttgaagcttcaaggactgatctcaggagcataggatggagaacacactctcaaggagatgaaaagcccttttcaagccatgagggtgacctcctataatgaccttgacccaaatgttctggtgatggctgcttcatggggagcaaaaggaatactgtcttaataataatttattgtctatttcaaaatacgcagaaaaatagatttataatgtttctgacacaaagtaatgataaatggttgaggtgatgcataccccaattagccagatttgatcattatatattgtatatgcttgtatcaaaatactgcatgtgttccatacataggtacaactataatatatccataaaacttttttttaaaaggatgcttcctgaaaaactgaggcaaactgcactaagtgatatttatatctttgtataacgctgcagaatgctaggagttcgttccaccatattgactaaatatacttgctaagataaggtgtaacgattccatctttaacattataataaaaagaaacacccgggagacttcttatgagcctctatttgataatatgccatgtgtattatatatagttgggttacttttaactgattttaacaacataaaggcaaattttcaagtaattgcaatgttttaataagctaatttttaaaatttatattatatgaacttttttcctaccattgattttttcccccagactctgacacccctccgtactcttttttctatctcccggaccatattaataaggttcagcaatcattgtttgctgattgagtttgacttcccatgtaatgctttgggcaacggatatttgcatgcagagaaatgtggtcctctccttggctcaccacctcactgccaggaaactaccccttcaagagctgactgaccagggctggacagttaactcactcctccagtccaaataatatgttccttattcatatgtttttattcaatcattcattcatattttcataatctctctctcccttacacacacttatacacacatacacacacacacacacacgtgaatttttataattaagtatataaagactgaaaaatggcaaattcatcttggcaaatacccaaagtaaagcccatcagcagagaataagaaacactgagtgataagatagctgagagtcccctgagatcttggccttgggccgggctccttctgcaccttggaccagaactggctttggactcttcaatctttgaacacatttccttttttagttgcaggcaaaacaatcataagcaaatgctgtccgtcactgttttcctacatgtacccaatgcattgagggagataacatacactcctggggtggccaggaatgcagaggaccagaagcgaatgggtcaattagccactaaccctcccccgtccacctgcacttcctccagagacataggcaagtgtgcacttgagcacaagtacatgcacacatgtgtacgatggatacagacattcatctttatattaacccaggcagcagcatgatccgaaaaatgccatctatattaacatcatcagctagggttaattgaatatctgttaagtaactttggtgtcagcaaaagtatcaaattctatttttagacatcacataatacaatagatattattcagtttaagcagaatagacactacatcctttcatatatacataattcctaaagctgagtatttctttgtacattgcaattatttttagaggaacgtaactaaaacttttccctaaatatgatttaaataataatttaaatgtcaaaaatattttaatcttatccattgcaagaatttataatttataaacctttaaaaattatattcttctgaaataaattatatcaattttctaatgttatgttaccctagtacaggacttggcaaactatagtcagcaggccaaatcaggcctaccacctattattataaataaagttttattaaaactcagccatccatattcatatacttattgtctatagccggctttgtaccatcatggcagagttgatgagccataccagagatcacgtggcctgcaaagtctctgcatttactatctggccctgtacagaaaatgtttgcaaagtcttgctctagccaattatggcaaagtaacttaaaaattatttccctcaagccctaatttttaaaaaataaaatgtcatcatgttcaaccaaactcaatagattctgaatatccttccagatattctgaatattctgaataccagaatagtagattctgaatattgctgtcttcaaaaacacttatggattaagaggataagcaagcaaatgtataagataaatgtaaaagagacacatgacatatctaaaatagaattaaaagcacttcacaaaactgggaaaatattaaaatatgttttaggatactttatgaatcaagggttctataggaattacgtgacaccatcacataagataatttgaagaaggcttgacaagacaactatcaacaaagacacaggtgtggaagaggcaaacacaagagttcccagtggctactaaggggcccaaaggaatgctgggggataaagggtcataaagggagagccaggtgggtgtggctgctgcggtgtgaggccagggccacagccagtcccaggtaacccagtggcagccagtggtgggaatcgcagctcggacttccctcccctttctcccacaggccttccaaggaccttttccatggccctatccagctggccgcgagagggcacaggggcatgacagcagtcatagaagcttcccagtacagaggcagaaacagacgctgggaggggcaagagaaaatagccagcaggagttcactttctttcgaagatgataaaacaggagaaaataaatgtgaaactgttctctacagtgtttatatttctagccaagaacactctcatgaatgaaattcattttctaaaattagggcaatgctaagaataagtcttttctccaacattaaaataaaaataaatttaccaaaaaatggttgcataatgaagtggctggaaccaaaatgtagtcttggtaagattaagcccacagtagctaatgtacaagttgtaaactatatctcattcatatcatgttgatatttgaaagaagtagaaatgaggacacacaaaaaaaaggaaagcatttttacctcatccttcaaacaaaaacaaaagtattttttctcccaaaatgatttttaaattaaatgcttcttttgtcagaaagtgaatcctagcgtagtgacattgccattgatggtttaagcctattagagacctgtgttgctcacgaaacatgttgaataggactctaacagtattttcacaaatgtttttctcccacatcctcatcaatgagatctggcatttacttccaatcagtgtatatgtcttcatttatatattataaacacatacagctgtgcatgtatataagtatattttaaatacagtatacacatctgaaaataatgacatcaagataaaatgattgatattataaagtaaatattatgttatagtctgatttaacaaaactttttaaacttagtgcaataatttatgatagaatgaattaaaattctgttttctacattcaatttatattaatttttagtttaaaaacttctataactgaagtggacaactcaaacagatatataaatccaatttcttgggaggctgaggcagatcgcgaggtcaggagattgagaacatcctggctgacacggtgaaaccccgtctctacaaaaaatacaaaaaattagccaggcgtggtggcacgtgccggtagtcccagcaattcaggaggctgaggcaggagaatcacttgaacccaggaggtggaggttacagtgagacgagattgcgccactgcattccagcctgggtgacagagcaagactgtctcaaaaataaaaaaaaaaaaatccaattacatcattggctgtttttaataaattttgatatactactttttcaacttcatctgccaattagacaatgttttttgttgaaatttgccaagcacattttcatcttcactgatgtcaatatcttgtgctcaaaaatttatcagaaagattaaaaaatgagcttaaagtccactgaaacttcccttttgggagttttaaaaaagggttaaaagtacacataagacatttcaaaagtgaattttctaaatttatatatttaaaaatcaggtaagattgttattatagtgattgttgagcatcatcattaacaaccaattcacataaggacagaaatcttctgaggtatctgatttaaaaattacttttaatttttttatttcaataggttttttggaaacaggtggtgtttggttatatgaataagttttttcgtggtgatttctgagattttgggggcacctatcacccaagcaggctacactgtacccaatgtgtagtcttttatccctcaccccctcccaccctttcctcttagtcctcaaagtccattgtatcgttcttatgcctttgaataattatagttaagcactcccattatgagtgagaacatatgatgtttggttttccattcctgagttacttcacttagaataatggtttccaggtccatgcagcttgctgtaaatgccattatttcattcatttttatgatatacatatatatacactacattttctttatctacttgttgactgatgggcatttggattggttcaatatttttgcagttgagtattgtgctgctatattgcatgagtttcttttggaaagcaattacggtctcattaattgtgaaacaagacaatttcttttctacaggtacctactattcatcatactattaaaaataacaggaagttcagcaaatttagatcccttatatcttaaaaaaggagaaataggtacatagagatgatagcgctagatatacagaaacattgatatatgtgtatatacatacacatccattgacgttaagcttcacaatttttcaatatcttaaattaatgacagctctttaaatatgttgccactaggtatccagagaccctccctataaaacagaaaataatggttctttcccacctcatttcaaaacattataaatactctcccatgttaaataacataacacaaaaatgcactttactggaacttgtaagtcaaaacccttccaatatttccctgattccctcaggatgccttagaaactcactttggcatgtgtcagagcttgacatattgagcaagtgaggcaccagcatcaacttacattttaatattagtacattttacattgctgtggtataaacattctagaaacagaatttcccattttctttccatccgtctcttgagatcactgctattgactctagactacctgcttcagaatcacatttagatgtttgctaaaaatggtcgttcttggccactggagtcagaatcaatgagaagtggagtcacaaaacccagagtttaaacaagttctggatgcggcagattttgcacttcgcggatggtcccagcagcatgtcccccacaggctctcctgcatgcaacctgctggtcatccatccacaactggagtctatttctctaccaccttggattctggaaagcctaactcctttgaccaataaaatatgaccgaagagctcctttgccagttccaggcatggccttaactggcctggaagcttcatttccagtctcttgaaggcaggtgccatgtaagaagttcagccatccagagaccaccatgttaggagagaataaagagatgacatggtgggcaaaatgacaaatggagaagaaaggaggatgtagaagcaggaaagagagagagagagagaaagagagagagagagagaaaggagacagagacagataccaaggagcaatggcatgcagtccctgtgagtggatcaaccaccttgaatatggaacctccagtccaagcagcctcatctgatgccaacacaatcataaacaaacttctcagccaagttctttttttttttttttttgacttttggaattttggaattttggaattcctgatcaacaaaattgtgagcaaaataaaacggttgttttaaatcactatgttttgtggtgctgattaggtagcaattaataactgaaacaagaagtcattattttgctacaagtaaggatgtctagtcaagattctctccctgcccatcccaagtctccatacaggaagccccattcccctacctgggatttgcggtgaggctgcagccctagaaagatggctggctgtcacccctgcctcaggagtcctcgaggctacttttggtcaacactataactgaagcagaagcaacagtggcgtttagaagatgtcaaacatggaaataatgacttcttggacttatacaagtatttaaccctcctttccctttgttgaatgcctgacatcccacgtttgtaaatcaattctgtgaatcctccagcccatttatggtccataacttaaattgcatcaaataatttcaaacacggtagttaccagtatatacttgatttataaaattcacagttataacaatatgttaactcgtttactcaatctaaaaccttaaggaaaacattactattattcctgagagggaactgaaatacagtgagattaagtaacttgcccgaggacacacacccagtaagttgaggcagtggctactcagatcatatatccccaaaccctcttcattactgtcttcagttattaatacagaaattgtagttaggatgtcaggtaaataaatggtgaatttccataaaccaaagggaatttacagaaatattaactattctaaaattctttccaagtttaaacaatcaattttcatggtgatttattcaataaaagctgcaaaaaaaaccatgtttgtttgaaaatacacactcaagtccatacaaagaaaaaaatcaactgtttagattatatgagtaattcaaaaggtgaagcagtttctattgtgtagaccagggtttctcaaccaggtgcgattttgcaccccagggaacacgtggaagtgtctagagacagctttggttgtcattactagtatgtgtggggtgtgctactggcatctaggggtacaggccaaggatgctgttaaacatcctacactgcacaggacagaacccccatgaccaagaattatctggcccaaaacatcaatagtgtgcaggtgcagaaaccctgatgcgaaacgtgatcgaggcgtttcttctgccctgatcatcctttcttgtggtcatctcctctccctgctctgagccttggtagcactgtttcatatcccacactgaataccttgtgatggcactgccactaccactgttcatttttcaggtccataaatcttatcttgtcaactggaacgtgagctgctagagagctctcaggtctctctctctctctctcctggaagaatgtagtgcaaggaggtggcatctgatatctttttgtcaacacggtttataatttctaatttcttgaatacttgaaatgaaatactcaaagccatccaggtaactgcctccttctgagaaaatgtcttccttgagtgtcttttacttcttaagggtttaagaagccatctcctcacccagggccatatgaaaaataaacttccctttgttttaatttccaagaggaagttatcaccaagggacacaaacttgaacttttgaacatggaatggtcaacattccagcttttatactcactgtatggacaatcagtaattgctgctttttaacagtaggaataaatctaatacatgttattaaattctgcatattttgtcacagtttgtgtttgtgtaattttcctttcatgcctgttgcacttgtgttatttgatcatctaatttctcttttacttttctttctcctcctccaaaatggaggcttatttacatcaattattgatctgccatatgtctaatttagccctatgtccagtacttgaactagagaaactgttaaaccaaattagtaataatgtttaggctagaggtggaggggatattgggtaggtactttttgcaaaagtgaatacataattaaataaaaaatagtaatactgttggtggccacattagctgtaaactaacatagagaaaagaaataatgagcaattggttcctttctttgtaagatcccaattgcagtccatacagttattctccatgacttatcacagggtagtccctctgccaatagtggtataagtgaattgaaaacacattacattttaattaatcatttaattaaaggaaaaagagagacatgaaaatgaaacagggaacaaaagctcaggtcacatacagcaatgggtgatctccaaatcttgtctccctgtctttgaaataagaccagacagcatttggccttccggtacatcgtcacctcccctctcagctcggctgcagccactcaaggtttgggacttcaaagtgccatgactcctcataggcattaagcctacagtataagccccagcacccccaacctgcctcactctgtggacttgcacacaaccatgggccactttccatccacatcatcaaagctgtccaaaaatggggcaggggaccctggccttcgtttcaaaaattacagttctgccagatgccacgagatggatgctaaaaccctgttccttcctggattcccctgcctgctcctcacacaaatatggatgtcatgcctctttcatgtcaacacctattgtgctgaactctacacttggaatgtctcaatacctagtgctgtccttataccttgacgaaaactctccctagatttactgagcactctacttgcttaaccactcagaatccaaacacaacatatgtcatctgctttgtccagggaattggacttctaaacacttcccccatggagaagataatccactcttcctttacactgagaggtctcaatgaagaaatggcttccaaaccagccaataatccagccccattttcacatctacctgattcaacaattcattcattcattcattatgtctctcactcattcactttcacttggtctgttttcctccttcatccctcccctccttctcttccaccaccagaattctcaattagcctttcaaatacccacaagaaagtcccactgtaatcctcaccatcactcaaggtcactagcgccaaagcacaacttcctgtcttccatccctataactggcctacacatccagaccctcaaaacccactctccctgctactctccagtgcttctgggatcggatacactattttcatagcccctgtcagggtccattcccacaaagtatgactcacaacaggctccagagctctagtttcccagggttcatgttcaaagtagggattcccgctaccccaaattcttattcagtaagcataaaaaggatttggggatttccattattaaaagtccatttgggtgaatctgatgatcaacagattctagaactcctgtgctcaaaagacagtaagcctctcatcctaactgccttttgtaatgctgatgctattgacagaggcagtgcctaggattaaactcccctttgtgagttggaattctggtttgcaaactccatctacttttcaaaattaagtgaacaaagagaaagatgggaagccaaataattcacactgaatgtttgaatcttaggctgggcagaatttgatagttgtctaggtggtacatgggagtgactggggagaaggacgagtgatggggaaggaggaggaggaggaggattttctactcttcagagcttatggcagaaagttatcagcatgtgagctggagccaggtggtctgagagctaatctggaatgcaccaaggctgcagatacttgatgctgacctgatttcctcatgcaaaatcaggataaagatgatacctatcaaatataagcactgataagattaaatggaataatgcatgctgagctcttaccataaagctggatataaaataataactcaatattagctatgatcatcattatatgcataagatttaggaaaacttaacctctttattttgttatatatcttcagagaattacattgtacacatccagacgacctgagtggaaatcattgttctcatccaaatatcacccaatgctttctttaattctaggtagaataatcaaaaaagacactttgtctccatatgccaaataacagccccaatcagccagtggaacaaccagataattacttatcaactaaggggtattttaatgtgatgcatgataactaaggacttaaaatcacaaatacaatcatgccaatttttaaagggatgtgtaattggggcaagaaaatagagagttgaaccccacagaaggaaagaaatagaatctaaaaatatcagttattttaaaagttcaataaaggctattagtgtataaaatgtataattaatttactatctgtatatccgtttacaggcttatcatatctttgaggttgatctataaatcttcaaatatattaattatatttaaccagctgtggtaaactgcgatttgtcaaaaactggtaaaacactgttttctttttaaagcagctaaatgtaatatatttataatgagcccttcttgcatcagctataagtacatgatgtgacataatttataactataaatatacattttatatgtaaatagaaaagtctctgtattctatttgaaatactgtacttttcacaaatgcattgcttaacaattaatgtggtcaaatcttataatgccaaaatgttttttaattatgtatttcatacctttatgctcaagcttaatttggttacctgttattctctaattacaaaaaggaatcttcatttaagaaagtcttggaccaaatataaaacatcattcagaaagcaggccggtcaaaaagtaaaagcttatggtttctaaatttcaggatttctttatgaaaaaatgtcttctgtagtattttacaatttttaaatttcaggatttgtacaggcagtagtaacaggcaggaaaggagggtaaggggaaggagaaacagcatatttcctacaggtgagacattatgctccaaactgtgatctcaaaaaaaaaaaaaaaaaaagatataaaaacatttccttagggagctttaatggattactgagttactatgggcggaaacttcttgatctctttctgggagacaaccaaaaaggtgcagctaaagctcagagaagaaaatcagcatggctgagcttccattatgagaaaatacatgaaaacagtattggatggtggtcacccaagaaaatgcaataatagctgaatgttggaaagtgacaaattcaacctaaaaaaatacatatatatatacatatacatatgtatatacacatacatatgtatatacacatacatacacacatactttttcctaagttttttttctatcgactcaaatatttcacaaagggggaattacgcctgcaggagcacatagctgtggtgtgaatgactgtgtcctctgagaaattcatatgttgaaatcctaacctctcaaggcctgcaggtggtgattaggtcacgagggtgacaccttctgattgagattagtgccctgataaaaaaggaatcagagaactcagtcagtcgccacttccactatgtgtgtgccctcagcagacactgaaccttcaggtgccttgttcctggactttcaggccttcagaactgtgagcaataaatttctgttttttttgtttacttgtttttgagagagtatctcactccaattgcccaggctggagtgtagtggcatgatcttggctcactacagcctcaacctcccaggctcaaatgatcctcccacctcagtctcccgagtagctgggactacaggtacatgccaccatgtcaagctatttttttttttttgtatttttagtaaagacagggtttttccatgttgcccagactggtcttgaactcctgggctcaagccacctgcctaccttggccacccaaatcactggggttacaggtgtgaatcactgggattacaggtgtgaaccaccatgcctggccaatttctgttgtttacaagttacccagcctagggtatttgggaaaacagcctatataaactaaaacacacacaaatacacatagagttaaagaatatatagctataaagttaggtgaccaaaatgtcctctagtcatcaaaaattatactaatgtcattatgacttgaactgtgtcctccccaaaagatacggtgaagtcctaacccccagtacctaacaaataatctcatttggaaattaggtttttacagaggtaatcaagttaaaatgagatcattagggtgggccataatccatatgtgtcctatgaaaaagggaaatttggatgctgagccagacaagcatagaggaaagaggatgtgaagacatgcaggagaagatggccaaaaggcttgagtggtgatgtgtgtacaagctgagaatgccaaggattgctggcaaccacctgcagctaacgaggtgaggaagaagactcccctagagccttagggaagaatatggccctgccaacacttgattttagatttcaggcctccagaactgtgaggtcatccatttctgttgtgttaagccacctagcttttgtttctctgttatagcaggtctaagaaactaatacacatgcgtagaacagaagtatcacaacccagtcctttttttatcttctaagtttttttaaaagttctctcctaaataaacaaaaatacataagtaatctttaaaacttacataggttaagtttctagtgctgtactgattggttcaattgttaagaatattgactataaggtcagttctgtctttgacatagagttttgaataaggagtttgatggaaaatatctgtagattaaggttctttttcaagactgtgatggtagctgacatttttgcagctttaaatatatactgagtcacatccttagtaaagaaggaaggtaatcgtcaaacattttaaaataccccattgttataagattttgaaataccattatcacagcatttcagtaatgaactctcacagccttcagctctgcccactgttgaagagaagtaatcagtctagatgcatacttcccttatggagcttttaggggcataatatccatccagttagtcatttggacaggcttgataaactaagcccacagtcaacctgccattaaaagcagagtgagttagatttgtggcatcctcagtattaattaaacattgatggtgggcatcactgttcagaagaagggggcatctttacctaatgtgcgcgcaaatctcaacagtcttagagctgaaagggcccttagagatcatctattcatctggtctaatcctgttggaatggggaatctcatattagaactgcgggtaagagagtaggtgaagaaggagcctggcattagaggggagactattaaaataatacctggcaggaattgatgtggatggagagtatagacagaagatgttcagtgtcgagcaaaagaaatagcaagtggagatgggcctggaaggtttgaattcagttggaggaaatcaagcaaacacccaggagaaaggcaagttggggatgatgagttcacacctatctcctgcaggggactttctctgagctgaccttgtatttttaccagcttccaatcttgggtggggtgctgaccagtggagtgggagaggaagacttggcagaaaatcttcactagtgacccaagtcaaccttgccagcgttgggctcagatgtcaactttaagcatcccttgaggcataaacttaggcagaatttgatcatttacaaacacctgtcatttgaacaggttttgggaaggaggccataaatgttaacacctttctctgctctcccaactgaaactctaaaatgccaaagaatattttcaggaaaacatagtgtgcttactccaaatggcacagacaaaagccatacttcacgtctccttccctgatggggccaggcctcagatatccaaatgtagctgagatgtaacagaagagttttaaggcccctcagtggccctgctctaatgagagccagaagttcccaatgctgccacctcaagatattattacagtactgaaatgacatccaaaacacgaacaaaaagaaaactgaaattctgccctcttgtttctcctcacttttttggggggcggggggcaggtcttgctctgttagactggggtgcactggcactatcatggctcactgcagcatcgagctccccagtctccagtgatcctcctgccttggcctcccatgtagctggacctacaggcacaccccaccacacctgactaatttttgtaatttttgtagagacagggtttcgccatgttacccaggctggtctcaaactcctgggttcaagtgatccacccgtcttagcctccaaaagtgttgggactgcaggcgtgagccactgcgcccggccatttctcctcatttctaatgccatgtcctgggtgctgaacaggatagtcccctacaacacagaattatctgacctacatttccatagtgctgagatgaagaaactctgagaaggagaaaaagaggatagtaatttggaacaaatcttacagccataatacaggagtagccttatgtcaccatgggtaggtagaatctcttccaaacaaagaggcataaacccaggaatattttcttctgaagatctcctgaatactacctgaattgggttgaatggtggcctcccaaaacatatatctatttggaacctgtaatggtaaccttatttggagaaaggatcttagcaaatgtaattaagaatcccaagatgacatcatcctggataatcctggtgaatcctaaatccagttgcaagtatccttataaaagaaagttcagggctatattagacacatagacacacaaaggaagccatgtgaagatggaggcagagattggagtttgaaatcaaagaacacctggagccactagaactggaaaaggcgatgaagctttctcccctagagtcttcaaagggagtggagccctgctgatatctcagtttctgacttccaggctccagcactgtaaaaggatagattttagttgtttttaagccaccaaatttgtggtaatttgttattgcatccctagaaagctaatacactactaaacagataatatgttcagacaacttatattctctctaatggccagaactgactggtttaaatgtgacttcagaaaaactttgacaactatattaacaagctaagtgtttctcatgagttacatgagctaaatgacttccttcaccaaaggtaatgtttagtattttaaacagaagaaagtcacacttggtatttgtatcacagacaactttctaaagacagcctcttatctcagagttgataaattttaggcagcgaattcataagcatcaggtgtctcaaaatgtgcaacgtcattgaaatctgtttcgagaagttttaatgtgagcagcagacaggagtaaaatcgtattacgcaagcccttcaggctctctggcaagtgataaaaactcaatgccaactaggttacgccaaaaacaaaagcacagattcaagcataaactcagggagtcaaagtatgctgtaagaattccatggttcttactcctagttacaatggcctctgttgggccttcttcttggaaagactccatatggtgacaagatggctgcaagtagcctgcacttgacgtcactctttgagctcatgattgcaaagaagaaattggtcttgcagctctcaggcacagtgcaatgtcattaaaggccactgattaagggcacttgggtcatttacagcactcaggacccagaggatattattctcttgttgggcttcctgggagacctgcccacctgcaatatatgagaaagaggagccatgcatattagcttcctgtggctgctgtaacaaatggccagcaatttggtggcttaaatcaatatgactttattctctcacagttctggagagaagtcagaaatcagtatcaatgggccaaactcaaggtggtagcagagctatgctcccctaggagggcctaggggagaatccatcgccccttgcagctctgagtggctgccagctttccttagctgtagttgcatcactctaattttcaaagcccatctcttcaaatctctctcaaatccatcttcacatggcttgctcctctgtgtgtgtgtaatcttcttctgcatctctcttctaaaaacacatgtgattgtatctaagaggcacccagataatccagaaaaatcttcccatttcaagatccttaatataatcacatctttgccatgtaaggtcacatttagaagtttcaggaattagatatcttttggagggccatttttcagcctactgcatgatatcactgacaatactgctcaagtcacagggagtagagtcctggcaatcccagaaaaataaataaggcactgacagatgcaccttacaggctaacgcatggatcatctctcagctgtctgctaaatacaatgacgtcattacagaactgagccatcacataagccaaactcaatctcatacttgctttacatttatggtggggctaaacaacagatagtggtagaaacagcacatttcatttcatgctctcattcatgtgttcattatgctcatgaacctggataattcacagctgtttctcagtgcaaatatgcaatgttcatcaaggcatgatctcagagcacaagcacctaagatgctataatatcgatattgaacacatctagacaaagataaacctttagaaattgacatagaaccacctactgtcacatgctagcagagtagggaactctgctgacggtgagaaagaagatacatatccattagttcaatgtgttttccctgactcatcttaggctctaaacagcaggaagaaaaagaggccgcttgacaaatactaattataatgtagatagaaatttcaaagccagattttttaattttgcctgttttctttatgaatcaatctaaatttattagcctttgctagtgctataagtcatgcatatatatgacagacaatttgggaaattatggtaaagtataaaatgaaaaatccaaaccactcaccacatggaaacaaccacttgctaatttacttatttcaaatagtaaatttaacttaaatacacacacacacacacatacacacacatatatatatataatttttttttttttttgagacagagtctcgctctgttgcccaggctagagtgcagtggcgccatctcggcttactgcaatctccgcctcctaggttcatgccattctcctgcctcagcctccccagtagctgggaatacaggcgcccaccaccatgcccggctaattttttgtattttcagtagaggtggggtttcaccgtgttagccaggatggtctcaatctcctaacctcgtgatccacctgcctcggcctcccaaagtgctgggaacttgaatatattttaaaaagaacttgaggatagattcaaagaatgcctgaacttcatatttcttcaccataaatatcaactcctaaaaacttcccaaaagataccattaattttttttaagtttacacacatagatacatgtttctttgtagcatacatttatgtttctaggaggtataatatattataaaatagctggaagagagactttcgaatgttctcaccataaagaaatgataaatgaatgaggtgatgaataagctaaatacccaaatttgatgattatgccaaatatatatgtacagaagcatcaattttatcccatcaatatgtacaaatacaatgtgccaataaatatttttaaaggaatacattaaaaatcacttaatcagaatccaaagaaacaaaagacaatccttgaaaactataagtttaacaaatcctatataaaatattttaaaaataacatattttgaaatttgagcttgcttttagcattaccctcaaagacatacagaagggaaacaatgagcatttctccagcaaaatattcccttttgtaaaagatagatcacttgttgaagaaaaacaaaatagacatggaaaattgattttatcatgaactataataaagcctgagaaattacacacaagtagactgtggtgtttatgttccaccaaaatttgttgttttcatttcttagactcaactactcaaaataaccctatttgttttataattggagcagttttcttggatgcctgttttctcttgtatacctatttatctttgttgtctatataatttccaatagtatttccatttttcttagtgataaaaataatcttcatataattaacactttctctttgttaaacttgtgatttgtgtaaaaaaatctacttttctcataaagtcatttttatagaatcttctaatttgttccttaataattttcgatgaactatgtctatgaaagaacatatccttattttttgtgaattctttatcgatctgatttgtccttttcatgtcagtcttttcatactttatgaatataatatcatctttatattatttttaaagttaaacatacactcaattcataaagaaatctgcaagatctaaaataataaagaaagccctctatgtcatacagcctatatagtttgcttaaagcaaaaactttcaactctttaactggtttatttatgtatttttctccaaatttgtaactaataatattttactgctgtttcttgatattttcagttagaaatattattcactggctcctttttactttatccctcttcctccatcaacatagatgcatgctccctcccccactttctcagtattgatttatgatgattctgtaggaatatgcagtacctacataactatgcaaatactcttcacagatgggccatgaaataagattttactacatcttgtttctcaaaacaattatacgtttcttagagttaataattgtctcttgtttttctatgtagttattatctttttgtcccccacaccgaaatgtaagtctcctttttgtctaaatgcattcaaacacctcagatatcccattattgatatcctcctggaaagatgccttcggtaactgtatcatctactccaacctggactggtggctcccaaggcccgccgcacaacagttccacaattatctccctttgccctcatcccaggaatatttttctccctctcgcctgtattggagcctctatttcctgggcctagtgtgttaaccattcatatatttcccttgatttttcatctcttagtctttattcaactttctgggaaatttttatcaaatttatttactaattttccatggatatttttatttctatgatcatatattttcaaaataatctatgaagccttttgaaatacactgaatatttcttttctccttgtttcatggtagtaatatcttctctaatttcagaagacattcatcataatttcttgtctctctgtcttccaagtttcttatttaatttggttcactctgtgtttttcgtaactgggaactgcaagaacattagagctgggcacccacattgctttgtagaccagccatcattgcttaatctgggtgggatttttttgtattagagtgaccaccgatgtcactatccttaaggttctagttgtaagctgattagataccaacaaaagtgtacgccaaaacccatataaaatatatgcaaagagaaacaccaacaccggggagaagggctaggatctcaatatacagtatatatactgtgtgtgtgtgcgtatatatatatatatatatttacacgcacacacacacacacacacacatatatacacatacatacatatacatatatactgaattctccccttcttttttaagggaagttctcaggggaaatcttggtcccctggtccaatatatcagcagctttgtcatcttccagaattgcactactgtcttcttccagcatggcagaggaacaactgtgttgagacacaaagtgagcgagcaggaagatctgggttctaactgcttcttccattgtctcctgagtttgtggtttctcttgaaaaactggctatggatcttatttttactcctctgaaggttatgtctttttctgttacttgattatttttaagatttatcccttttccacgagttttcagaagtctgactataacgtgctggtgtggttatctattgtatttgaggtttgcagagcttcttagtctgtgagttgatacctttcatcactttggaaaagtttcagtgataattaccaggcacatagcttctgccttgtcctcttccttctccttttgagactcaagttgtatgtgagttagagttttcaaggtgtcatgtgtgtctaatactcttttatctaccctttccaattcctctctgtatttcagtttgaatattttccacagactggtcttccagttcactaatacaatattttttttctgctatgtctaatctgctgttaaaataattcatatagttccatatgtcagatattatttgtttttaaaaaattatagaaaatttatttgattcttttttattctaatgttctggtaaaattctccactctttaattaatctgtctaaattatcctctactttcttccttatattaatcataattatttaaagttaccttctgctaactttactaactgtatcatctgtcactttcatcagccaagagcaactctccagaggaaggggcagctatgaaccagtatcaaacaaccctcacaatagccagggatagggtgccctgttctataaggagagctgggtagggtgtctcttgtgttcatagagattttcctttgatgtacctttattgtcacttaaatgctttattttaaatcaatgaaagaacagtacataggttcccttcatcttgaatcagaaactaatggctatggtttaaaattgcatttgattttgatgctcctttattcaaatggtgcttggcaattcttaggcaatgaattgcatgaggtcttcggactccagatattaccaaaattacatgtatagtcatgcctaatttcgtataaagcagcctattcttagtagggaatttctgcatgggcaacttgcctctgcgatctaagatgcatgtaaataataactgagtattgccaaaaattgaaagtagaattgaatttcaaaaattaaactgagcaaccaacccatataaaatcattgaagggatcatgtagtatcacttgaaaaagtggcaatagcccccacaacagtaagaattgatacaagcagattaaacattgtgttctaatgaagaagtattatataaactcttaaaggttagctatgagagcacagcaaaaggattgtttgtcaaacatatgttaaacaagggtgttgtccattgcagccctatccacaatgactctacccatctctgtgacagttatcaataaattctggatgacaaatggcttacatgttaaagagtcaacaaattaagggttccaatccatccactccagagagtggtcagccaatgtgacttttttttttttcatttatgtttctcctttgctttttattttcactttgttcttaggtaattgggagacagcttacagaacacattatctcttactcaaacaagaaatcattactaaaatttggagcaatgagttttcctggtatgttggcttatttatttttgttagcattttggaagggacatacagataagggaaatgaacacagggcagagaattctgagcatgcccatcactcagcagtcatggcacttatgggggccatttttgacatagaaggagaaatgcattttagataaatgaaatgaactcctccatttatctagcagcttgtgattgtcagacagtgtttgctattggattacataaattgcctgacttcgtttcatgaaactaaatgatatacatgactaacaaatatattcatgcatcttcaatttagtttttgaggccacaagcaaagcaacaatttagaaatggataaagagagttattagaaattaagatatgcacaacacaaaagaatgaattcaataataaagtatgtacttttttgtcaaagacataaaaacacttcatttcagtggcagagactagtgtctgttcggtcagagtcaggaacatcaagaaaactctaagtaagatacctaaaagtattgagtattatcaatcatagtgggtgctatcggcaccccatccagctcttatgaaacaggacactgtatccctggctgctgtcactgttagctgatcctggttcatagcttcccaactctctggagaattgctcctggttaatgagagccacctcaccaggaagttatgtcaccaaacactccaaatgtggcagccgaagaacaagggagagttggttataaatcgccacagcccttgcctcaaatgggattaacagcggttctatatatgctctagagctgcatctgggatcgggttgaggctatactccagctgacaggaaatttttgcctacttcctttctttgctatgtcacacactccctaccttttgagagcatgccttaagtaaatcacatgcttgagaacccctatctcagactgtgtttccagggtaccaaacctaaaacccatatttgaatttcaattaaaaattaacggttatattcactgtaagccagatgtcaactataggtcgtatgctggccagtacaaatgagtacaataaagcagcaattgtcctctggagccctacacacccaggtccaaatcctagctctaccacctatcagatggctgatcttggctaaatcacataaacttgtagacctcaactcctctgctgttgaatattgaaaataatacccccactttagtgctgctggagaactcgatgagatgatgcttgcaaagtgccaagaacagagtaagggcaggatgagtgatgcctgctattatttttgttgctgtcatcatgatttcatgacaaattaggtcattaaagttacatcaaataagcataatgccaagtttcaaattagtagggaatgttttccttaaacaggagttcaggcattacttaagcaagacagaagaaagagtaagtggaaggatgatgcatattaaaaatttaatcctggcagagaattcagggataaatccagtgtactcttcttcctggctgtcctctccaaaatgtactatagagaaaattgaggtaaagagaggttaagtggcttgctcaaagtattcctgcttgttatttacagaaatgttagaatcatgaagaaatctgttggtacgtagcaaaaaaattagaatggtatggcggggtgggatgagggtagaacagggaacagttaagtgtatccccaggggccggtcttgttttccctagcacagactaggagaaaatgctaatatctgtcaatgtctgaatgcatacaaaccacatatcccaacctgccttgtgatttcttgaagttatgtgactgagttatggccagtggaatttgggcacaagggatgcacttcctggcatggcatgatcctttgcatgatcctccactcgaatttgtctttcttccctactgcctctggaggcatggattgaagacgggataccataagagaacactgtgggatcctgaacggcagcatggaaccaagccccacagactgcactggactcacttgcgagggaggaataagtcttctgcatgtgaatgttcagcttctaggagggcgcagttgttttaatggcagttaacttggttcatattctctgaaactagtaaaatcttagtcctcatctacataaaatatacataatcaactataaatcttccagaacgttatttaaaaagtagagtaaatatgtttgaataaatcggtatataaaacagcatctgacagaaaatcttcaccaagggaacagatataagagcctagaatctgaggaggaccgttggtaacgctgtctcaggttaccaacttctgggtcaagatcaactggggatcatgtaattattacacagcgagtccaaataaacacagcaatcaaacattgataaactaaaaaaaaatactgagtcatattgtgttcactcatcaattcaggaaatattcattgagaacttgccgagtactaggtaccataataggtgacaaactttttcttaaaggaagagagagtcacatagtttatattttaggcttggtaggccaggcagtctctgtggctactggtcaagttagctgaacagcagccatagatgttatgttaaaaaaaaatgaacaatatgtctggattccaaataaaacttcattaactattattataggccaacgacatgcaaatgaatggctatgttccaataatacctttactatgatcaacataccttagttgttaactcctgaaagattttaataaaaataatctttaaaatccacttctatgacaataagaacatatgacaaagataggcaaaaaaataaatgagctcagaatcatgatttttgagagctgtgggggagaccagtctctccttgcccaataaatataaaacataatttaaaaaattaatcattgtgaatatctcattggaatagttattctaaattattaattaatatatcatgctttaaattatacagaagaattccaacagagggtagttatattatagtgttatgacccattagagagggtattataaattgcctcaatttatttttaaatttaatttcatattaataaaaggaagtaatttaaacacaagaatcccagcagcttctttagaactggcaactaaagattcatagtttgcatatatacatatatatatatatgaacacacatatgtatatgtgtatatatatacacacaatatatatattgcatatataatatatatatacatgaacacacatatgaatctttagtgtttagatttcttcatatgtggagacatatatattcaacatatatacatagaaatctaaaccgaaaaattccctaagcacatcaaagatcttatatgttcaatcaagtaatcttaatatcacagattagaaaatggcttctttaaaacatgtggaaactgaggcaacaatcaaggaacatagggtttctcaacgttggcactgttagcattcagagtcaggtaaatttcgctcaacgggggggtcctgctctgtgcattgtagaaggtttggtaccacccctggtctctacacgctagatgccagtcaaagcttcccccaccagttgtgacaactaataatgtccccagatattgccaaatattcccagaaggtgaaattgtcggaagttgagaacttctagtctaaaaattgactcacgttgaaactcaatccccccaacccagatatacaggaaagaagttaataatgtggcacatatacaccatggaatactatgcagccataaaaatgatgagtttatgtcctttgtagggacatggatgaaattggaaatcatcattcccagtaaactatcgcaaggacaaaaaaacaaacaccacatgttctcactcataggtgggaattgaacaaggagaacacatggacacaggaaggggaacatcacactccggggactgttgtggggtcgggggaggggggagggataacattaggagatatacctaaagctaaatgatgagttaatgggtacagcacaccaacaaggcacatgtatacatatgtaacaaacctgcacattgtgcccatgtaccctaaaacttaaagtataatgataataaaataaaataaaataaaaagaagaaagaagttaatatccactttaactttggagagaattctctaccgatattgatcatgtagtcagagagatttaagttttcaatttagaaaccatagagaggcaggtggcaaattggaacacagatttcattttttctgcttatcccagcatttgtgagtgagaaacaagcagtgaatttatttccgttagaaacaaaacaatataaaaatggatttggagctatttcccaaaagaattttagtaagacagtgaggttaaatgagctccagcccctttgtgttttttgaactctgttcagtgagcatctacctccagccatctgcggtaggatcccagatgggcaaatgctgtgaattagtctgaggccagctccatttttatatttttcaaaaagctttgttcttataaaataatctccatgattaaggcaagaagaaaacttatactgaagatttgaatctgttattatgacatgaggtaaaagaaacaaattatggccaaccatcactatgcctgaaaatgactggttttcaataggggatggctaaacttcagcatgcagtgagttgcaaaaaaaaaaaaaaaaaaaattatcacagtctctgagcaaacaggtgccttataagtgaaaataagttaacatttgattctctagtcattgatgataaacaggttttattttcttaaattaaaagcaactcttggtctttaaatgttaagagacatcttctcttaatatgttaaggcatacctgtctgaaaatcataagaaatattccaaatatagccattttacttcatagtacatttgtatgtgaatattcatatggtcatgccaagagatttacctcatacagataacattcactcagggtaacagagtacttgtatcccaattcctgctcaaatcttcacggctttagcaattccaccagtgatgtttctagtttgtcaaaaagacaagattttttttggcaaaagggaagagacttccgatttgaagtactgttgactccatgtccaaaatattccttacaccagatttatcaggcaacctgtcttggaagtgagttttctcctttgggagccaccccacaaaagcctatttttctcatcactcaatttcagtatggttctacagagctgagccgccatgtgtgacagtgctttgatagatatcataaggtcacagaatggtgggagaggagtggagagggtgcactaaggtggtgtccccgtgctcctactgtagccaggaagtgtgctggctgctggatggaaaataccaccctggatttcagggcaattgacaagggacaatgcagtggggtctccagaattctatgaatgtcactaagtaggaaaaaagaagaatcattattcaacatccgctttctcatcattgttgctaaaccaatgtcaaagcaggagaaaaaatttgggagagaggaaaattgtaaaacagtattgagaagacaagtggttagtatgtaaggaatgaatatatcagtcaggagttgcctgtctcatccacgaattgtcccctggggtgacagtatgcacatgtgtgttttaggatgtctcttctgaaagcatttcttataactctagcttctgggttaacgttacttttcttttcttgaatttagggacaaaaatatgatgtttacctcccactccattaaagttatgtttaaaaaggttagggaagagtaagcatattaaatactaagggacagaaacttgtaagccatctgttttgactctaccaccttccaggtaacctaatctaataatatcatctaattctgaacatataaaaagaaagaaaacacttcttacaacacagagaatgaatttcaacatgaaacaataagtactagtcagaagtaaaggctatgaggctgtgaaatgcctcagagggtcaccagccaagcaggcacagaatgggttacaaagaggtgttgtctccagtgaaactcaaggatgggcagtctttttcttcaggaagaagataaatagggtgaaggtgattgagacaggacagcaagagcaaatgcttcaagttggaaaatagcctacagtttggaaaacaatatgcagcatgacatgaccagacaaggtagaaactgccctcaggtgatcaggagagtcacaggtaatgcaaactgccacctggaggtgaacctctgtcctgcataggggcaggacccaaggatgccttgtctagtgttaaataaaggttactggtgaactacattcatttctcattgtctccagttttcttgaaattggttgtcctccttgatctgtttcatcatttttctacatttaaacaataatttttaactttggagagagaaaaggagaaaaatattaacctgagatatacaaatcaacccccatgatttgtggtagaaaaccatctttctatgtaataattgaaagcacacaagtcaaacgttctgtcacttattatctaaaactgtgttttccaatggggcgcaccagcgatccagaacacttcaactctagctggtccaaatccaaatgtgatggaaatataaaacacacactggagtttgaagactgagttccagaaaaaaaaaaaaaaagtgcaacagatcattaatttcttacaatgattctatgctgaaattaaaatattttggatatattgaggtagtaaaatatactgttagtagtcatttcccttgcttctttgtacttttttcagtgtgcctagcagatcatcttaaattacctatttggctcacatggtgcttctatcagacggcactgttataagaccctttgtctaccagtgtgcttattcctttctgttatacttgggaactgtcatgtaaattaaaataaaatattcatagaaaccaacaaggcctctttgctggagacacgtgatataaaaaaaaaaagtgtgtcatgaattgccagccttctctctccagactaagtaaacagtaggctacagaactccgtacacagccacataatatgaaaaagcagaattgccctgctttgcaccaatggtacagcagtctgacctctatcattagagccgcatttttaaaaccacagttcaaaaagtcacgtcttcttgcttggtgctatgtcagtagactaagctctcaccacgtggtggtactgatgggcatcctatacttcagtaacagctcatcaatcccatcaataattgcaacctgatttccaccgaaggcagccaagaccaaggaggcaatgatgagaaaagtacaatcagtttccttgacctcacaaaaatatatacacatgagttaatggaaatacatctcctcacttttttgcatctatttatttggacatcatgtcagtaaaatttgcaaaaatatcacaatagactctcataagcccttcacctagattcccctgttaacactgtatcatatttgctttattatatttgcctctgcacatgtgtatagcttctatgtatgtatgtgtataacaattttaaaagctattttgatataagttacagaaatgatatccattatccctatatcttttagcatgcttttccaaaaaacaatgacattctcctatattacagttatcaaaatcaacaaattaatattaatacatttctactatcttatccagacatttgaatttctccagttgtccaaataatgtcctttatagtaagaaaaaatatatctgctgcaagattcaatttgggtcaagtattgcatttgatccccatgtctatttgttgagctttatgatggaagagctctttattatttcttcttttttcatacctttcatgacttcgtgatatctgaagggtagaggccagttttttgtaggatgtccctcagtgtatctgatggttcctcatgataaagttattagttataattttggttataatttttggctgaaatatcaaggacatcttgctgcgtcctctgtgcatcaaatcactgaactctgtcccattgctggtgaagttccccttgacctttgactatttggtcatgggctatttgccagatttctttactatcaagttataagttttcctgttgtaattaataagtatcatataggtaagtactttaagactaccatgaataaatatcctggctgtcatcaaactctgacccataaattagcatctattgatcacttttgcctaaatcgatttttagtataatggttgccaaatcataatctcctaatcaaattattccttcaatattcattagttggcatttgtttactcatttatttatgttttatgttagcatctactcatggattcttatgttattcaatgtgttataatctacctctggcattatctattttgacaatcaaattgccccagatttcttcagcgagcccacttcaagctggctcctagtttcttatgacacaccctcatcattctttaaatattttccttaatttctgaaacaacaagctcttccagtcttatctgagttctccttgcccaattctagattaagtcacttctcaaaaaaatccttcgtttgttttcatggagaattaagtttagaaacaaagtaacatgtatcaagtgtgttcactgctactaagaatacttctaaaccctctcagctgacggagctagcaaatttaaaaagaaatgaatgcgtatatgtaaatatatgtttgtgcacacacagacctacaaaacctcactttttaacacaagtgatatgccagagagtataccatgagaatcaaaatgagtataatatgtagtttctatctactaaacgatatatattttagaaaaggttatctaaaacaatctttaaaatggcattatgattaaattgttgatcattctttttttaattagcaaataaaaattatatatattgatagtgtacaacatgtcactttgatatacgtatacgttgtggaatggctaaatcaagctaattaatatgcaggtatctcacatactttatttatttatttatttattttggtgttgagaacacttgaaatctactctgttagcaattttcaagcacatagtacattgttagtagttatagtcaccatgtcatacaatggatctctttaacttattcctttgtctaactggaatttcttgttctgtggccaacatctccctaacaccttccctgaccttctgggcccctggaaaccaccagtccactctctgctcctaagagtttgtctttttagatttcacacataagtgagatcttgcagttttgtctttctgtgcctggattatttcactgaaggtaatgtcttcaaattgctgatcattctgattccttaataataaattcataattttaccactcaattagctcaatgaaagactccagttatgtactaaattgcagtggaaagacaatttattgtcaattgtgataaaactattataatggagatttattatttattatcatcactttaaaaaatcaagaataatagaaaattcttgataaattgcaatgttttatctcttttgaacgtcttacttatttttcgccatgctagtatggagttggcagtgatttgtgaccatttcacagatgaggaaccaataattcctagaagtcatggaactagatcacaaatcaggttgatgtgtcttcaaagcccttgctttttatcaatattagctttgatcaggggattggctgattttaacaccttgctaagtaaaagatagatttaatattaaaacctagctctgaagttccctaaatgttcacaagcagcagcattaaagagagaataaaataatataaaatcctctccaatcacctcttagagctctagcacatgagagtgagacgaaaattggttgaagaactttttccaaactctacacagcccgaagattctggcatagtctgtagggagttccagaatcttggtgaagaagatatttgtgtcttaactctcttattttctaggagacactttttaaagactagagggaaaagtgggcttttgtgactcagatctgctactaaaataaatacttcatttaagtacaagatctcaggtccattgttcaaaccgcaacaacagaagtaggtaaatttcattttgatctatttccctttattctttgttatagatagcttttaacccaagtattcatatttatgttaatataaattataaagaggaaacaaagctgttttacaagaaattgatgcccggatgcatcaaactaaataatcgatgattgctgtaactgtgggggaaggaatgtgtccaggctttgaagcaatgttccttgaatggtctgtcatctaaggaaggacaaatcaggatcacatccacggaacaaacagggccacctgacaggaggaaaaggctaatcaggaattaagggaggtaatgactcgtaacaagtagggccgccttagtcccgtggcctgacctgctgaggaaacgagcccctgctcaggctggattaacacctttacatgcatctgtcttcatcccctcaaacagtgagttaattgggatggaaaatgaaagcttgagaaaaataaattgcacctacctggataagagacagatcctcaagctgtaacctgaagaggtagtttctgcaaaatacaaaaacagagcagttttatttttaatagatcacagaaagttaagagtttataaaaatttcaagaacaaagaaaataataattttgacttcaaaagcatcttctttctaagaatatgttcagcactactttccttggatcttagagtacaaagaggaattcaagaggtcaacaaatacacattagagattggtgagaaagctaacgaataagtggggtgtgtctgtacatacttacggtaagtgtaagtcattaactggatctcttgatctatatggaataaataaaaggacatgggcattccattctgaaactcttttacttaagatgatgtacaactattcctcataggtcttcctttataattatcacctaaattcaccatgttttataattaagattttgaattcaagcaatgctctgaggttcacagtactctaccttgtaagatggattcagtacgtaataaacgtttagaaatatgaacttgggcccggcatggtggttcacacctgtaatcccagcactttgggaggctgaggcaggaggatattttgatcctgagaggcagaggttgccaggctcctgggaaccatggcaaaatctgtctctacaaaaaatacaaaagttatccaggcatattggcttatgcctatagtcccagctactcaggaggctgaggcaggaggatgctttggtcctgggaggtggaggttgcagtaagctgtgatcacaccactgcagttcagccagggtgacagggcgagaccctgtctcaaaaataaataaataaataataaatacataaatataacttgcattatataggatttggtttaaaaagaaaagaaaagaaacatgaacttggtggtctgcccaaaggaaactgatgacatcaagggcttcaaagagtcaagtttcactgcccaagtataaaataggaaattagagaaaagtaaaatatcaatttcaacaaagaaggggaagaatagtgaaacatgcagtggagatcagtagaggacacagaaaaaagatagattagttacactgggctttggactctagtgttgtaggttttagaaacaactcattaacctacctcagtattctttgcttcagcctctaactgaaatcctggcatcatgtaaatgggaagatggggcggggatgtgcaccagcagcaccccaaagaggaagggaggagaaagccagcctaagtgcaaataataatgtcaagaacatgctggcacataatggtaagcaaactctaagatgcaaatgagcacgaggtgggatctccaagaagccaaggatgctgttataatgggctggtccaaggtcacttcttattggttttacaacacctataagacataaatgttgactattttcactatcgtgggcggggggtgggggtaggtatataaactggacatatatcccagtagaagtgacaagtgacagccaaagaggcccaagggcatagccttgagatgaccaagaaacatccctatgagttatggacagagttagggaggacaaagcccccatggaagccggcactcagaagcacatgtacacacacagctgaaggatgaaagaggactaggctcacattcaggtagtctcatgagtccaggcattgcctcctgggcattcaggtttcacacagtttgcctcctcacatgggggtaccacctctctaaaccgagtgaaaacagcctcacccaaaccacagcaatagtctccttaccacactctttccacctttcaaatctcacctctgatataccccaagagaagctcccagaagcactgcttggcacatgccacctccatcacaaagccatttcaggaaacattcccctgtcctttattataatgctacagccctctatgtagaaccaggttaaggatacctctgaggggagggaatattacaggaaagtcttttgatttagtcagtgccatgagaagactaggactccaacagaaatgtcatctgcaggccaggcacattgccccgtaatcccagcactgtgggaggccaaggtgggccaatcacttgagtcctggagttctagacaggcctaggcaacatagggagaccctatctctacaaaaaaagaaaaaatacaaaaattagtcaggtggcatggtgcatgcttggagtcccagctactcaggaggctgaagtgggaggatccattgagcctgggaggtcaaggctccagtgagccacgatcctgtcactgcactccagcctgggtgacagagagagatcctgtctcaacaacaacaaaaagtccttttcagaggaacaaatgtgaacttggtgcacatacagaagagtatgttgaagcagccaaggtaggtggcactggagggtgactcgcatttcaacattagccaagctttcacccagtgtgaccttgaaaccagcacacctcctctaagggaagcaagaaatctacacacacacacagacaagtctttcagaagcggggcttaccagtgtgatatagtttggctgtgtccccacccaaatctcatcttgaattttaatccccataatccccatgtgtccagggaggggcctagtaggaggtgattggatcatgggggcgggttacttcatgttgttctcatgatactgagtgagtctcatgagatctgatggttttataagcatctggcatttcccctgcttgcatttctctctcctgccaccatgtgagaaggcccaagcttgcttccccttcaccttccaccatgattacaagttttctgagccctcccagccatgtataactgtgaatcaattaaacttatttcctttataaattacccagtctcagctatttctttatagtagtgtgagaacaaactagtacatagcggcaccagggaaattactagccattgtacacccgttgcctctatgagcagctcagctccccaccctcacatatttcccactgtctttctggtttcaggaggctgcccctctgctatgggagtcagcattacctagcaattaagaatattcatgcaaaaaccagagttctgcctctatacaatctcaggaagaaagcatttctttctatgccttagtcttttcatctgtaaaatggagctaataatcaaacccattccctagggttgttgtgaggtttaaatctaagaaaaacacttggaatgaagtctgacccattgtaagcatcaattaatggtgccaacttctatgttaattttgtcattggtcctggaatccagtcaccctactccttttcaacccactggcaattttaagaaggacttcttcagtaaatatttccaataaaagaaactcattcatttagtaaatgaattacctaagagctttggtgatatctcatggttcattctttcttgcttactcacacacatacacgtgcacatgtatgttcacactatggtatctgtctccagaaactttcttgaaaagaagctttcatacacaaaggaagagctggaagtgcatcagggccttgagaaaagacgatagcacagtctgcagtgctctgtagagctctgtgcagatcaagcagagagctctctgtctacttggagaggggagtggaggagacacagagatcgccatccacaacacctgcttccggttttcaggtgttttccatagaagaagataatggcttataataaaaaatacgccactttctcagtccacacctccataagcaaatataactcttctgatcattatttttctgcttctcaagttccaatgggctgtaaaggtacccctcctctccagaaacattgctagtggagtttaaccatctacctcttctccttccaaatacctgagagctatggtgcccttccaatcatctcatcagtaataacaaatcaatatggcagaggtattcaataggggaaaggaaggggcaaagaggagggaggggcatgcttactaggaaaaatagcacagttactatgaaataccatcaccagcaccagcaccatcaccatcaccacatccaataccccaggaaggaaagcaccagaggatttgaacttttctttttgtagtattttctgggttgcaagataaaaattggtgattattttaccccattccatatttttaatctaataatatagagtctaagaaatcaagaactaagagtcactaaagagtatatacccttcaatttatagatgagaaaacttctataaattaacagctgcagtgagatttgtccaatactgtaaggtttcagagaaagtcctgggattagaaacaagccccccgtgtcttggtgtcctttgtcccattatgcctcaaggccccacctattagttattcaatgtcaccttcctaatttcacctgcaccaaacatgcacacacacagaaacaaacacagtaacagctcttatgctactaccatttcataacttcactggtcatttacagcaacatttacaaatcattttaagaaaattcaagtcttagttctgctaataacaaacttttgatcctaggccatcaattttcacctctgggactgtgatctggctgtgatgtatgtctccccttgaggagaacagtttgagcctacgggtctggctgtttaaatggcacctcttttctctctttttattttgcctgaacaactccctgcccatacctaattctaagaatatccctatttcttaacttataaaatgaaagagataaactatacaattatctcaatgtatttaaataatacaaattcccaaaagactgtgaccatgtttagatatacacattgcctaactaagttctacgaataaatggccattcaacaaaagtatttttattatggcaaatttaaatcatttcctgagaagtgtttttcatgtgttatttttcacaactgagtaacttatttcaaaataatcttaaaagaaatctcaacatataaaatagatacaataattctttaatagtataaattgatgtaataagtacttatgtatttgttaataaaatcagttgatgaagctttcttaaaaaaattaaaactccacttatcagaactatttatcatcttacacagatcaacatctatttaatgtgtatattcatgccagttgattggttatatttttgttgattttttatttgtttgatttttaaggcacagagttggtaggtgcttttaaatgtttctttttttccttttttttttttttttttttctgagatggagtcttgcttcttcgcccaggctggagtgcaatggcatgatctcgactcactgcaacctccacttcctgggttcatgcaattctcctgcctcagcctccccagtagccaggattacactgacatgccaccacgcctgactaatttttatatttctggtagagacagggtttcaccatgttagccaggctggtcttgaactcctgacctcaagtgatcctcccaaagtgctgggattacaggtgtgagccaccacgcctggcctaaatattagtttaataaatgactatggtccatggaaaacccaagtagtcaaatacctcactacacaaacagtttagtattcaccttattacaattttcagctattttaaacaatattttattttattttttttttttgagatggagtctcgctcttccgcccaggccagagcgcagtggtgctatcttggctcactgcaagctctgcctcctgggttcacgccattctcctgcctcagcctcccgagtagctgggactacaggcgcccgccaccacacctggctaattttttgtatttttagtagagacggggtttcaccgtgttagccaggatggtctctatctcctgacctcatgatccacccacatcagcctcccaaagtgctgggattacaggcgtgagccaccgtgcctggcctaaacaatattttaaaaggtgaaccataagtaaaacatttgtggaattccctaatcacatcccaagaacctaagaatctgataaaacacagtgtggattctgctattctcaaatctctttccttgaactatttggccccacatacaactccaaatgcatttttgctgtaggaaaaattccaagccagctggcaacatgagggacttgaaatctctcaagacagcttgatccatcacagtttaggtcaatgacctacaaagttaaaggttacaaaaagagagaaaaccttctaaaggggataaaaaattgatattcccaggtgttgggccactcacaaactaaagtaagatctacagaaccctgcaagtggctgtcctccaaggtattacagaagaggcaaccactttatcttgcaattgtgtgagcacagaggagggaaaacaatatgcgtgaggttcatgagaaaggccaccagcctttccaacatgaaggaataatgcttctggcccctggccaactggaaatgctaaccaaatgttgcaagtagggtcagtctccctaacagggcaatgctttgagcaacccaaagcatttaagtgatctcattaatcttcataacacccctagatgtaaataggtagtaataaggaatattgccattcttcagggaaaaaggcagtggtgcaagaggttaagagattagattctttgaatgcattagttgtatagcttggaggaatgattctatacttctatttttctcctgtcattaccaaaatgaaaagcaagagtttgccaaagtgtaacagttcagtgttatggctatagcaaataaaaacatgagttttttctgcctgtggtatggatctacttttttttttttttctcaaatgccatggaataaaatttgacattgcacattcacgtgcaataaaccagattccttttaggagtaataacatatgaggagtacacagatccaatgggctgaataattcaaatcacaaagctattaagtttggcagatgcaaaatcacaatattgaagcccattcttcgtttccccactagacacctgagtgcgttttctacgtcttcaccaaagtttcttgcttactgactctaggattgaataactcattcctgggtcccatcacttcccccagtggcctattagaaacaaatcactaagcataacaatatattctcggagggagcagtggggaccttaatagatgaagttcatttgtatcttcatgtaaagtagtaaaatgcagccggcattaaagaaaaggttgagccatcatgagcatattaactaaatgactcatttcatctagagacactataaaacttaactttgacctccataaattatgaaagacacaggtgttttaaaaggacattctcttagaataactcaattggcctctgatgaatatgactataaaatcaaagaaaaaattacaagttcctattgaacgtatgagttagaggtttgcttacaactgagaaaagaagaattaaggaaggtagatttgtattttgtactagagcaaatgaaggcagaagccgataaaatgtataaagacattttaacaatgttgacagaaacgtttgttgctgattaataaaagtttagaccaaggctgatcacgaaacaatccaaagacaaaacagacactgcccatgagccagttggggaaggctgagagctgaccagtctctcctgtccctgcaccagcttcctgcacacaatactttcctcactgcaagtttccttccatcctcactgctgtcaacatctaactggcacagaacttttcaagtatagtgacatcctacatgatacgcacattttcaattgcactggtagacttttgaagataacaagttatgtttgagatggagtctcgctctgttgcccaggctggatgtgcagtggcagcatctcggctcactgcaacctccatcgcaggcattcagcaattcttgtgcctcagcctccagggtagctgagattacaggtgcgcgccaccatgcccagctaattttttgtgtgtttttagtagagatggggtttcgctgtgttggccaggctggtcttgaactcctgacctcaggtgatccccctgcctgggcctcccaaagtgctgggattacaggcatgagggaggccgaagcagacagatcacctgaggtcagtagttcgagactagcctggccaacatggcgggaacctacccctactaaatatacaaaaaaattagctgggcgtagtggtgcacaactgtaatcctatctacctgggaggctgaggcacgagaatccctgaatgtgcaaggtggaggttgcactgagcagagatcctgccactgcactccagcctgggctacagagcgagtctcaataaataaataaaataaggaaaaatagtaactatatcctttaaaacataaagtgttgtaaaattagtttgattatctaagtgtaaatatttaatatcgtgatcatatcagtaaatttaaatataatgatttaatttaatcatgtaaccaactcatataattcaccaattcaccagcatgtctataattgtgatttccaagacttttcattatgctggtcgactctaagtaaattctaggagactttttattttgtggttataactatcctaaaaaatgtctgcttcatgtatttttttcatgggtttctcagaagataattaaatttcaaaattacaaagcctttccaaatagtatcacattatatttaaatagttagatcacatttaaatcacagtttttaattcttttgtgagtttttttctaaaatattttaaaatatggtgacaaatttataatatggtcatgtgattagctatctcctcagtcagaattttctctaccctcctcaaaaatagtaaatatgtattcttcgggctatgcaaatttcaagataactgtaatttaatttttgttgctgttaatactgttacgtgtgtctggtacccattctcccagaatcatattaacttctttcattccctatcccagaaagagcattttgagctccttaaaagtcttggttattagaaataaatttcaaagaacacactaaaactgagatcaaaccattttaatagcattcttatatatttaaataccaagattaaaaggtgcaaaaatagatggatagtctcttattatttagcaagtagaatgaaataacaaagatacattttaatggcatgcagtaactaaacaatgccgccagcaaatcttagagatataaaatcaggaaaatattttcccacaaatatatttagggtaaaagttattaatcaatattgttaataattacactaatagtttacattttattatgctttaattattacttgcaaatctctaagtgctgtgaggattacagatgatgatttattgctctaaatttaactcgcgacttttgcctttgtgggtcctctgggtatctgatttgttcctttctgtttttcagttaacagagataatttttcatttgaaaaaaaatgccaactgaatatttctatggttcctttaacctgtgatttcctaggactattcatgctttaaattatctccatatacaattaattttctaggttatcttcagtattcatacaaatctgagatcttttttctcatgtatcttctaataatcaaagaattacagctcatcctcccatatgctctatcccagtcacactcccaaaactcactgaatggtttgatgcttcccaccagccaacccactctgttggccatcaattgctgtcaaaatcagaactgaaacgtgtctcaaatctggcttctcatctccattgccatcatcactgcctaagtctaagcaccctctactctcacctgatccacaacccgcaactgccatgcctcgctccaaattctgcaagttctagtgcctagtgcatcctgcacacaatatggtggacgtatcttcctaatgcaaatatgattatgtgaacatataaatgtagaaatctcctgggctcctcaatgcctttagcagaggttctcaaatttaccaagccagcagagcaatgggagcttgattaaatcaaagattctggccgggcacagtggctcatgcctgtaatcctagcactttgagaggccaaggtgggtggatcacttgaggtcaggagttcgagaccagcctggccaacatagtaaaaccctgtctccactaaaaatacaattagccggatatggtggtgggtgcctgcaatctcagctactcgggaggctgaggcaggagaattgcttgaaccaaggaatcagaggttgcagtgagccgagatcataccattgcaccactgcactccagcctgggcaacaagagtgatgctctctctcacaaaaaagattctggcattacttccggaaagtggaattcagaggacttgaggacaggcctggacatctacactcttgaaaggcctgtcaggtgaacctaagactggcccagttggagtcactggtctagaggactaagtctaaacttctttataatctggccccagctaatgctcagagcttcacctataattacttccccctctctgtcaccaacaggtgccacggagccaagcacttttcagcctcatcagaatctctgacttttcccatgtgactctctgtcttccctgccagattcctcaagcatctctcaggccccgttggaggaacaccttctctatgcagcctcttcagatcgatgcaccatcatatccctttactcttggtgttttcaggaccctttactcaggcttcccttggagaatctaattgcttgtgcccgtctcacccactaggccaagatcatcatactttttgttttggggccagagagcagatagtttgcttttgtggtctatgtgccaactactcgtctctgcagttttagctcaaaagcagccacagaagatgtgtgaatgagtgggtgtggctgtgtgccaataaaagcatatttacaaaaacaggaggcaactctggggccccagcttgccaacccttgcgctggactagaaagtcctcatcaggtagagaagatgcttcatctttgtttctctaatgcctaagaagcttcctggcataaagtaggttcaataaatatttgagtaacacagagtcttgaaagaagaactacatgaactaatacatttggatgaaccccatgtggacctggtaggagaaaagctctcaatactcagtctgtagcacatgtacatgcaaataagttattcaattattatcacagccctttgttggtttgctcatgggatctgggaaataggaagcctttgtacatttatttatttatttacggctgtcccttggtatccccagagcattggctccaagaccacctcgagtgccaaaatccatggatgctccagtccctgatatcaaatggattggtatttgcctataacctatgcacatcttcccatatactttaaatcatctctagattacttatatcgagcacattataaatgtaaatagtcgttatgccatattgtttttattggtatcatttttattgttgtattgtttgtttttaatttttccaaatattttaggcttgtggttaaatctgcagatgcagaacccagggaggaccaactgtatgtacttacttgcttataactaaatagataactgttgtactaggctgatattctcccaactcaagcagggaaaaaaaaaatacagatgggaggccgaggtgggcggatcgccaggtcaggagattgagaccatcctggctaacatggtgaaaccccgcctctactaaaaatacaaaaaattagccgggcgtggtagcgggcgcctgtagtcccagctactcgggaggctgaggcagaagaatggcgtgaacccgggaggcggagcttgcagtgagctgagatcacaccactgcactccagcctgggcgacagagcgagactctgtctcaaaaaaaaaaaaaaaagtacagattagttttttttgtttttgtttttgtttttgttttgttttgtttttttacaatagcagaaggaacagaatggttagaaatctttcccaggcatgtcagttggccaccagtttgttaaaagcacacaccctgagccagctaaatcagcagagctgggaggggcatcttaattttgaacaaatgtcctagctaatacttaagaacattaatgtttggcaaatgttggacaaaaggtaacaaagccagcagacaacaaggagactttttaacatatattgggtaaattaatcaaataagcgaattagaagaaaggggagaacaagtagaagaaagagagagataagcccagagaatcataaaggacatacctgtgcataggggccagccctgagaaggaaagggacagagaaggggaaacctttaaaccctaaagtggaggttcataaagatttgattggaagaggacaaaaaagactgcagtgaaaagcactgttccttttccatcaccagctgcttgtcttaagtcataattaatgtaaacacaacatgaaaatcagcattacctgggatctcttcccacaatggggttctactcctttttgcattcactgctaatctctgatttcataccgctcagcatgtattccctttaattgtgtcaacttgactaaaatatactctttggaaaagacgaataagtgtggctactggaagcagaatcgctgatctgataaacatcttcagttttcctgttaattatatattgcctccaaaagagtaattccaaggtaaaattttcaagtaaaaataagaattataatcaccgaaaaataatgatattggccagttgtttaaaataaattttatgtgaatttaaaattaatcccccttgtttagaaccagtgtgataaagtcattttgtaaagaagaaactcattaaatagaagcctaccgtttattttatgcgtctcataagaatatatgctatgttaaaataattgggaggccattagattgaggaggcttcactgtcttgggttcctatgtaaacaaaccaaaattcaactcaatgtaaatagtaaaaggaaacttaagcttaaccaatcagaaacaaaaccctaactaaagtctaacttcagacttaaccaattagaaaccaccaactaacctctaactagggagtttccactttaaccaactagaggcattttctttgtcttgtttctgggaagaatattataaaagtttcctcccttgccacccccacccacaagtggagagctgctggaagtctggtgatgcttgattcctaaatctctaaatgttcaaataaacttgttaaaattttaatgcacctaagtttatcgtttaagggttttgaatacttacagcaaattcagccagagcataaaaacagcaagttaatctttccttttttatctgtagttttgtaaattcaaaccattagccaaacaaatggttcaaaataataaacgaaaaggatcagaaatccatactatttgttgcacatacatttatacagacatatcttctgatatctagaaatactgtaatggtaagtcaaggggtttagtgcaaggtattcaggcagctatgggctgatactcacattgggtcaggtgtgcaaggcgtgcagttatgggctggtactcacatcgggtcagaagtacaaggtgtgtagttatagactggtactcacactgggtcaggtgtgcaaagtgtgcagtatggactggtgcttacatcatgtcagatgtgcaaggcatgcagctctgggctggtactcacattgcgtcaggtgtgtgaggtatgcagctatgggctggtacattgggtcaggtgtgcaaggtgtgcaactatgggctgctactcacattgggtcaggtgtgcaacgtgtgcagttgtgggctggtactcacatggggtcagatgtgcaatgcatgcagctatgggttggtactcacattaggtcaggtatgtgaggcttgcagctttaggctagtactcacattgggtcaggtgtgtgaggcatgcagctataggctggtactcacattgggccaggtgtacaaggcatgcagctatgggctggcactcacattgggtcaggtgtgcaaggcatgcagctatgggctgctactcacattgggtcaggtgtgcaacgtgtgaagttgtgggctgctactcacattgggtcaggtgtgcaatgtgtgcagctatgggctggtactcacattacatcaggtatgtgaggcatgcagctatgggctgctactcacattgggccaggtgtgcaagaagactcatgcatctctagtgccttttgttcccttggtgacttaatgttctcattttgtgatgttattttgtatagaattaaaatcaaacatttccaaggacataaatcattatatctgctatgaattatgatcattacctgatccaagtattgggtctgtgggcctcaatcccaccaccttacccatggcagatgtttaggccatgtggactcacaggtatttgtttgagagcttacagacgaactttcttactaaaataccacagtttgtaagactgtaccctttgatttatgtttatattacactcaagctttttgggaaaagtaagagaatcagaattgagtaattggatgaaaataacttaaagaccaagaaacacatttaaaaacctgaagaaaattcacattttagaaactgagatagatgttaaaaaatgttttcatttagaaaaatcacattttgaagaaaagcacctaaatagccagaaagagtgactccacatcttccccacagttcagtggcaaagactcatgctacagatgctttgataataaactctttttcattagcactgtaggtctttatgcattataaaaatatggccaatttgtaaatgtccaacagcattcaaacactgccttatgtgtcaaccaagttagttggcatttggaataatacttggattcagcacagaatacatatcagagtaattcgggatggaatcacttgccacccttagaatgaacctgaaacactaaagacgaactaattcatttgggaaataaaaatgtaatcaccctcccttgtatctgttgcaacaattcaatctgcagtgaaacttacacttgtatcaagtgtgtggagtgttatcactgccattccttttataatcttctatacaaaaaccagtcataatatattctttcattttgaattttttataccaagaaactgatcttagtaggatttgtgacaaagaagtatgcaatcattcaacaaatattatcccaagagtaggaacaaatagaaatcaaataatgcaaggaaataactgaaatgcttcactgtgattatctctgaaattgtttttttctttatgctttactgtatattctacattttgtaaatgaagatacctaagtttcattactgaaaacacaaatattattaacttttaaagagactgggggaaaacaagatatgactgttgatgcatttaacataatacgaaagttcatgtgcatcctggaaatgaaaatgtatgacttcttccagaaattccctgaattcagatccaagtaccttccgattctccataaccacaaatggctgaaagagaggcttttcttttgcagcctaacgaacttcctttatcaaagagtacaaagaatctttaactgtttcaatttcaggaacatacagtatcactagtataaagtgaaaccatccaataaatggttccacaatgcctagtgctatgagaaaaaaaaatcgactattattctattttttcacaactcatatttttaaaccattactgatttctgaaatatacacctgttatctaaacttactcttgctaaatcaagctttgccaaacaggaatctgagggctgggttatttttaaagttttatatcttactcatatgccctctcaaactttctgagcctaatcccatgaaatttcccaggtgaaattcctattctcttctttaggtagcgtctgcctgaaaggcatatgcacacgtatgcgaaacccatgaagaccctcagagcttccctagggctgcgcgctcaccagcctgcctgttaatgtgacagtaacttctcacgggttattttatttcatcttcgcaacagctgaaaggggtagaaattgttgcatcatctttacaggtgataaaatcaggctctgaaactggcttagagtcacttaggtaggggccagcctctttttttttctgttattatttatcaagtgtctataatgtaccacacactgctctagaataaaaaactacagcccatgctcccggggtcaccaaacctttggaacatacttatgataaacatataaaaggttgttatttggaattcaaatttaactgggcatcatggatttttatttgctaagtctggcaatcctatgtattcatgtccaccatgccatacagcatgctaggttgactcagcggcccatccgatccttcccagcagaccatgttgatatgcaatggatggagacctccaggaatgaggtctgggatgaggactccagggatattgaattgcagattccaggggccctgggatggaagccacaagacacattgggatggagactctagggacgctgggatggacactctagagacattgggatggagacgacagggatgctggggtggaagctccagggaaactagaagacacagagatagagacttccaggaatgctgagatggaaaccattggagatattggacagagacctctagggatactgagagagagagagacaccccactgacactggaatagagaactccagggactctgggatgaagacctcctgggacaggtaccccttgaaaacaattcccagctgccatccacagccagaacaggagcataagacatctcttcaaaataccctaatttgctctgtggcttctcacatcccttaggaaaatcttgagtcactgaccaaaagccaaccacttgcagagaatgaagcgctggtctgttcacacagcacccaggacctccagagacaacaagagaatctcatgagtcaaagtcatagaaaagcctttccaaagttctttagagatgaatgagggatgcaagactcaaaacactaattggggtcacatttgtacctgccccaccccggtaaggggtctgttcccttgactcagagtgaaagctcattttccctcagggtgagctttggtgtatacagcctgccactggctcatgcccttgccagatgtaggtgtctgagataaattgttataatcccaacccccttttccctaagtgttcacctggatgcagaggggaacatagacaaattcaactctggaaataaatgtgttgaatcaacaggtatctttgagcttctataagcaggaaaaatctgtgctatatgctggagaaataaagaaaagacaggcacttcccttgccttctggtaagtcaccatctgataagggtgacttgtcaagaaataatgcaatattgtacattaagtgcagttaaaaaaaaaaagtagatgtccagtatgttactagggccacacaggacagagaatgtggtggttcaggactgctggtggacccttgagccaggtccttactacaagtgggagtttaccaagcagataatttggagtgggggttggtggcagccagtattccagaaaatgagaaagaggtcagaagggaaaaagcccagaggcaagaaagagcatattccataagtgtaggcagaataaataattccacatgcctggaccatgtgagaatgaaaacaggcaagtctggaagggaagtgggaatgcagggcagaagggctggcgtaccacaccagggagacagcttatatccaatgggagctactgaaggtgggcatttttaaaagatgatgttggctgtggtatgcagaaggaggagaacatctggaggccaggagactgatttaacaccactgcaaaacacaggccgaactccaagtgatgaaatttgttggaagtgagcatcagaaatcccccagtattgctactggactaaggtaaggaagagaacaccaagtagccttgtccaatccatactcaccgcctcctcacaaacgtcaaaagaggtgaaggtaacttgctaggtgcaataaactatgccaacttcttcctactcatgtaaaattacaaccattcatcacttcaagtgttgagtggatgtacaaggacacctcaagatccaagagcaaaagcaacgatcctagaaactgttcaatgtttatctagagtgcccagactataagctagatttagctgcactcgtgtttatagagagactgcaaaacctctgtagctatggcaggcatgctttatactctggtacatttggacaaaaaatataatgaactctccactgcccaatgtgccatccttagatgccagaggaacccaattctacaaatggaccctttcttaaactttaatgtcaattttcctaaaagatggatatataatcccaaaataggtaatttaaatgcaaggattatgcaggttttctaaggaagtgatagtgaaaacaggggaaagaactcaaatttgtttggattgtgttccagtggcctcattgtcaaactgggatgcagatgttgacctagatacgggaacactcacacccttaagagataaagataaaaataacttcgttgaatctcaatttactggtatatggcctaatcaaggtaacaaagaaaggtggtggtgggccttggggtacacatcaagatctctggatctctagaatcctactgaagaatatagtgggaagtcaggaacatgttttcaggagtcaaactgactgggtttggaacccaggtccatcttttcttaggcatatgccccggacaacttatttatctacttccttcctcagtttccacatctctaaaacagcaatgttgatagtacctacctcttaggtttgaatggaggaacaaatgagttaattcatgttagaacagttactggcacagggtgagggcccgatcaatgcttactctaacgggcagccatcaacatcttattagcagtagtatattttatgacactcatactgtatttcattcttataagaaataatattattcagcattcttcagttttgtcagtgaaggtcacatgtaactgcacagatgtaaaatgaagtccaaaaatatctgtggtggcaaaatacaatatctctcaccttgctcctacaacaagttctttctgtcctgggtcaaatgttaactgcgagaaatccacagcattcttcgctctgaactcccgtaaccaggggccaatttctaaatagaaaaaataaataaataaaaagataaaaatgaattatttttcctctggggaccacagatagtgcacatcaggtagcagacgttacatttcagagaggattcggaggtccctctatgccatctttcagaggccactggaggtttccctcaggatgccccataagccatactaagaacttgtaaagcacagagggcagccacccaataaagagcaagcgaggcatcaatgcttggttgtgatttacaagccagatgtgcattttccttttggctttgggctgggcagaaaataacacagcattcacatgattcatcagaggaatactgaatgcaaacaagaccatttcctgtgcaacttgactcaaaagagctgcagatttttaaatattacaaaagcctccttaggagcaaggaccaagcacacaagcatcatttgccttctttcaaattagatgttccatttccctgtcctttgggtttctattttggccccatgattagacttgttaaacacattccgacctttctagatgagaaatccacagttacttctaggcttcatttgcatttttttttctaagggaaatcagaaaatagccactctatagagacaggcttttacaagcacggttaactcctattagacagcctccagcccagagtccgataattataaaatgacagtatttgaggagagataggatgctgcttcaatgagccatttttgcaactttcattagctcatttttaacactaaaaaatattcagtgagttgcccaccaaacgtgggataccttatcattatcattgacaattaaccataacatctgattgtcgttttttcttggatttagtattttgaataacaccaccctgactaaccaggcacataacaactgtcaaatcaatgaagatgttggtttgaggaaaaagtgtgtgatacaggaaagaatctcctccaacaaacgctgatgctaaacacatcagtgttatgtttttaatgggggcatatggaaatatgcccccattccgtctcatatcctaaagaaatcgctttgttgatgtgaatgagagggactattttttcaggaatggttctgtataataaacatgtcttttctctactaacagttacgagggggaagtgatatcaagtaaaatttatcttctgcttaaaggaaaccaggggtgagtcatatagagagggacttgtaatgtatatgatagcttgatttttttaaggattttcatataaatttctacattttataggcaaatcaattaaaatacgtagaacaaggtatgtacaaggcaatggaactatgaaaagttattaataatccttccaggactttataattcagttaaagaaacagcactagtatctttaaacagggtgtctatcaatgcaagtgtttataggggcttgtggggttacaggaattattcttatatgaaaagaagagatgattgagagctgcagtaaaacaagaggaaagatttgaccagagagtgacaggaaagatgtcctagaggggcaaagcaagacagcaacatgggaggccatggtgccccctgtggccataactggtatcactcatcttcactccatcaatgcctccattcctgggcaaaagagaacccaatggctcttgcgtctgcattgctccctgcagtgcatgcagcatacaaaacagcacattgaatgcgataggaaataataaatatgtgaaatgaagtaagaacaagtaagtgagttcaagagagaaataatcaaaaagaaaggaaataagaaaaagagaaaggagaaaagaaaaagtaatagcaacttaagaaactactaggaaaggaaactgaaaggtgtatttaaatacaaactgtagaaaaattcactttcaggttaaaaggtttggacttgatttcatatgtgacagcaaagctttgaaacgttttcaggaaaactcttgacccatttgagcagatgtctttggaatatcaatgagcccttgatagaaagaatggtctggaaagagtagagaatggaaggaaaagtagtatatttttaaaaacctaaaaacctacaatttaggtattggccttgaaaatgaataaagaagatgtgggatcactgattagagatgaagtcaaggtaaacaacttaaaaagaacaaaacagttaccaaattaaatgaagaagaaaacagtgatgactgagacaggcatcagagtttgaggtggctttagagaaagatagtaaattcaggtgcaagaatgggaatgtttcaggtgaaaaatttccaatggtaggttggcccacagccattgttaaacatcgctaagacctagaaatgtccataaagatgttctagttcaggaggttcatcattcagatgggaaacacatgaccagggagcactgccaggaccaggctccagagtgaatatcaggggctctgttcaccacaactcacagcccccagagctgggctcacatccaatcttcaaaccacatgagggaagaacagagggccaagggctgaccttcctgctaggggagtgaagagatgagcctctaagaggaaaaaagactacgaaagatagaagaaaatcaggttactcttttcccatgcattcatctttctttttatttagaagacttggaagaaagtggccaacaggaaccaggctaaagagacatacatcaggttttggtccctatactgaacaacgggaaggcagttttgctacttcctaaaataccctgaagtaataaaaggagtcatgtacagaggaaaaaatgagttaacagcatgtagttctgtcaatattgttcaagtttccttatttgaaattctaatgaactttcccaataaaactgtgtatttttatggttaacatagatcaaagttgagtaatctgcatattcccttctctttcctccagaaggttggccatctcaactttgcatattacattggcttctatctcactgataccaagagagccttgcaagaaagtctctgcaccaactcacctcttgaactaaaaagaagcctgcaccaatacctatcctcccaactttcccaacagatcagagaaaaggcactcaatcctcttttcaaagaccagttgctctcatctcttctttcccctttaatcgcttctcaattacctaggctttcctctaaaatctccaatgttacctagtccctttccctctgcctatatgtacatcctctcctatttcaaaaagcattacatatttttattacactcccttgttattatagcttcaaaaaccccaataaaatgcataataaacttccaagtacaatatagcaatatatcaaaaaaaaaatcacacacatacaaacacacacacacacatacacacacacacacacacacatacactatatttcatagggaatagggcttagcccagaaacgcaaggatggctcagcaagcttagtaacagaaaacctattactataattcatcatcacaataacagatttcagtagtagcaggaaaacgtcatcaatactgctttctaaggaatcagaaaatgaacagttttggaaatagaagatctaaaagagttcagggcaattggtcacaaactagatgccagaggaagttcggggagagtgagggagcaggagggggtccacagcaagtggtgaattgaggggatacaattttcaataacattaagatgctcattgcccccagtgagtttacctttttcctcctatccctattttctgatattgctgaaataaccatatgatgaaatggagcttaaatatggcagccaatatgactatatatatataatatatataatatatattatatatatataaaattggaagttaagttataacataaaatttgtaaattccaactgaacacttgatagataattcataatatttgaggttaactatcctagataatccaatttttacacatatatttacgtgattgttgaaatatggtctccagcaatgattttttattgcaaaattacattcattgattcttagttgccttctcttacagctacataagctcgcatgtgattggtgtataaaatattttatcaaaagtataattccattttttttaataatccagtcttacaacttcaagaaacgatttattttatgaacaagtcagtattaataatttggtccaaaatacttgacaaatataactagagataagctaaatagattcaagttaatgtcccttccaaaaaagaaagaaaaaaaaatcaaagaaaaaagaaatgcaaagaaaaagaaagggaaagaggggtaaaagctactcttttaaaaaaagcagacactctaaatatagccaaggtaatgatgtttgtaaaccaaaacaacaacagcaacaaacaaacaataaagggcagctcttgtggaagacatgacagtcattccaaaatctgactgagagccactccacatgctaacacctgcagcgccaactgtccagaaaccaatctgatttgttagcaaacactgaccagggaaacctcccaggcacactaagggctggctccggatacctgtttcattcctcacaccttcaaacttcagttaattaaggggctgagaaagcaggatttcaaaagctatatgggtgacttgaaacccacattggaaactaagattcaagccaaactaggtggggccaggggacggtgggtaaagattgttgaaaagcacggagagcaacttacataacacacataagtacagtatgtagaaatacaagtgcatatcacagcctacttctatttatcatgtagttatgtaaccgatttagtctgcatcatgacaaaataacgctaacaatatgattatcagcaagacagctcaaaaatagctaatgtttaaatagtaggttctatcttatccactttataactattaattcctgtatttctcacacctgccttatcataggtgaagaaactgaggcattgtaagagtgagtgttgccaagatcaatagctggtaagatacaaacccaaccagcatagtttttgtggttctagccactatgctatattattaaacttcagcaaatataaaatttagcttcctatacagcacatttggaaaattacaggaagaaagaaaaatcgacagcctctccactttgaaagttactctattcccattgatagactgttaagcaaaatcactacgcactcagttttcaactatggactagagaaaaatgaaatacaacagaaagctgggtctctcaaaaccagctactactttaacctgtgaataaaatattgattgtttttgcccatgttaataagggtgatgatctacacaaaaaccattcatcattttttattacccaagtgtctttatgtaagtatggaggaagaaaatgacaaccatgtactgatctgctttattggagtaaagaacattctgaaatcagaacgtaggaatgatacaagcactgtggaatgcttgagtttctaagcagtctaaaccactcaactccaatacaggagttggggggcagggacaaggtactgtcctgaaaatgaaagagctgtgtcttcacctcctcaagatgggaaccttctgtgagcagcacaggaaaagaagtacagggcatattctctgtggagaaattctggaagttcttttttctgacctcttcctgaagttgtgaaaagatccatcctacctcaaaggtagggacctattactccttaaagttggcatgcttctcccttctatggacttcatttttggtttcagtgcattacataaaccatcctatcaatgaaatctgagccaaaactatgatagaaaaacaagggagtggaatgtttaaaagctaacacaagtagaagaagagcacggcaggtctgtgctggtttactatgctgtgtcttgcctgctaccagtttccttccctttcctttgcagtttgcgttaccaggcctgttacttcaacaaccactcagaacaaggtaatctcactttggacaataaatcagcagcaaccccatgccacgtgtacccccaaaataagatacatcaggctttcaaccaacttggttccctcaaatcttttcagtgattatcatagctttcagtcccaaagcttcacacacttgtctggtgccagcgtgtgaatgcaaaacacgtcataagggaataaacatgcacattcatagatgtttaaaatatgctgctgaaaaacatacatatcagaataaccaacatttcttacttatacttctttatttactaactatattttcagtactgacttggtatcaggaattgtatgagatacttttacatattaactatttttatgtttataatcttgtgaagcgagagctatcatttttgttataaaatttttttaaaccctgaaattttgacaagttaaatatccaaacatgacataaggaataagtagctaaactggaatttacatccagaataaggctaaggcaatatttctataagacacagattaaaaatcaattttccaaggaatgcataaagagcatgaatccttactgcctagtaacatatacgcatggattaatttatcaaaaatggtagttgtacccagcaaaggagagaaaaattggaaagaagggaagctggtaatttccagataggagacaggaatgttccagcttggctgcccactgagcaggacataagtgaaggaggagtaccccagagaaaaacagaaagaaaccagggcacaccccaggcagcaagaagtccaggggaaagaagatctcaatattggagaatttatctccctcaaatgactttccaagacaagtcctatttacattagcaaactccaaaatgtacagatatgctaaaccttacttttgctttgtagaaaggttggaaaatatgaggccaattttttatctccaaatatatgagcctctactattttcagtataactcctattgagggcttagttgaatcaaagcaggttacagcagggcatgacattagctgcacttcagtccagcccttgactttatagttgagggcaggtgtgttacaccacctgcccaaggctatgcatgtgcagtgagctggaaaatcccaggtcctaaggttcctttgctggtctattttcttccccatcacagcactagtagaatatctaagtagaagtaccatggctgaacctcacctaacaccggcatttagatcctgagatttgacaagtatttatggtatggcctgaaaatcatgcaaacaattgaaaacatgaggtaaacccacccctgtttcagaaaggtagtggatttcaattggttacaagatgatcattgtttccaatggaattctgcttcctaacattcctcttaaaatatccaggaaaaatatcaaacatgtttctttagttgttctatattatccttcaacaatctaacttggagaaatgatgggcctggaaagtcacatgggagtcccttccagacatgaagcctgtccaccacctgccctggcagccttggtcaccagctgcctccccatgcaggcccctgctcctgccttcactggaatgcatgcattctttcctacaatttcacagattggtggttagtatttaatgctgatttacattatggatatatatttataacatggattccaggatgtaaaaaaaaaaaaaaaagtggtctgtaccaggctgaccacattatctgagcacatgaaaatttctaaatgatagtattttaaatgaccaaaattatatgtatctatagttatcaatatatctcagtcccaaggccatcccactcagcaagcatcctccttcaaactacccagtataagaacaagaaagctcttgcagactgcacttagtgaagtagattaagctttccaaatgtggattatagtcatattgtatctagatatattgtatataagtatatacacaatacatatactgtattatacacaacacaatacatattttgtgtatatgtatgcagtgtatatgtatacacatgtatttatttctatatatctgtatacatatagacacacatatacatgatagggagagaaggcagagagattctaggtggacatgggagggtccctggagaagaatcaccctcaagcttaaaagcctgacagactgcagcccaaagtgacaacttatattctgttttcctgcttgaatgttaccttttcctaaaccacccatgttcccaccccaccccatcctgtgcctataaagaccccagactcagctggcagagaggagaagctgctggacattgtggactatggctggatgttggagagaagttggcttgacttcagagggacagtttgatggtgtaactttgaagaagaatctggccagagatgtccggactccaggggaagataaccttcctgccccatcccctttccagctccccttccactgagacccactttcattggcatttatcaccatttacctccacatttaccacccttcagttcgctcatgtaacctcatttttcctggacaccagacaagagcttggaaaccatgggggcagacacaaaagggcctgctgagctgttaacatttaagctatctgcaggcagcagagctaaaagagcactgtaatatgccctctggggtttcaggggtcacaggttccccactagatgttggtgcggggcctacagggagttggctcctgccagcatccaaaattgctcaccctggctcctgcatctgctcacctgtatgctccctccagcatggggtggaacacggagggtctgagtcagtggaactcacccctgctagtgccaaagtggccagctggttccagcgtgtgtgcactccatttccggcctcgtttgcacactccctcccacaggagttgagagctgagggctgagtaaatgaggcatccctatcacaagtcctgggaaggggtcagggaaatatctggcttcatacacacatagatatataaatataggcatcaatgtggtcattgtgtatatatatatgtgtgtgtgtgtgtgtgtgtgtatatatatatatatgtatttgcctaagtgtattcaaatagatattatagacacttaatagactacagtagaaagaaaaaaattatctcaaaaaatgtctacaggaaatgagtctgtcccatttatagaacttttaaaaaacaaaaatatttaataataaccaattagagaaattaaaacatttcgtatcacgaaaaaagacccaaaatagcaggaagcataaagcatctttcatttgcattttcctttgtaaatatgacactgaaaacacagcattttaaaaatgcaagcagtgctttttcgaatcttttctggtttctattgcagtctgttgaaagtgagtcaagtgttctatcaagtcttcatatgattttgttgcattaacacatagtatacctaacccatttctcacatgttcattgtagaaaaatattcacaaactacaacttttgcaaaaggtctacactctggatttggattcttgtgaagttcactgtttcatcttgggcaggcttcctggtggatgtctcagaaaccaaaaagctgtgatagctcctttttactcgatgagttcctgattgggtcttccttcaaacaccatttgaaaactacaagcttgtgtcacacatttttttcttttcttttttttttacatcctggaatctatggcataaaatgtatccataatgtaaatcagcattaaatactaaccaccaacctgtgattgtaggaaaaaatgcgtgcactgtttcagtgagggcaggagcagggacctgcatggagaggcagctggtgatcaaggctgctggggcaggcggcagacaggcttcatgtccagaagggactcctgtgtgactttccagacctaccgtttctctaagctagatcgtcgtcacaagataatactgaacaactaaacatatttttccttggtattttgagagaaatcttaggaagcaaaatttcactggaaccaattaccatcttgtaaccaattgaaatgcactacctttctgaaacaggggtgggattaataaattccactgttaccccacgttttcaattctttgcatgattttcaggccataccacaaataacttgtcaaatctcaggatctaaatgccagtgttaggtgagggtctggctactccagcccaaggagttccgagtcattcaagggttgcctcagacccacctggcaagtgcaaagagacactagtgaaaagttgtctgtaatctgagttcaaaatctgcctcacaggctagagttgccttcccttttgtttataactttcaagatcttggtaaattcctatttcattaaaccatctgaagcaattaattaggataagaaacaagctgataagtgcctgggttttattgctagataactcctagaagaagcaatttctactcatccatcaggaaagacagattttttttaaatttataagattatgcaaattcatatattataacacaaactaagcatgaccctcaaattcctggactgtgattaactttgtccttcaggctatgaagttggtgcccagcctgcccctcccttcaactttacgtggcttcaaagtactttgagtcacccataggaaactttgcccagtgcagaagggttttcattttgactcctgacctgcagcatatgattttaggctataaaatctaattgcaaaatctccatgttgtgacaaagaacaacaaaaagtaatttcccttagatttataactttagaattacaaatgatgttaatatgactaaaattacaaaaatgaacaatttctattcaataggcacttagattattccagaagtggccaaagtgctggctgtgtaaacagtgatagccagaagactgacagcaaagaaagccattcgccaccagataacgacagagattgcagaggaacgtgccagagatttcttagagccttagggtgtgtggttttaaaatatccagaatagttctgctacatattcagaatttgccagacctcagctttaagacaataaatcatttgcttaaggaaaatctctttctgtcacattctcacaattcacacgtaagtttcctgtctgcctcctcactataggaaaatctttagcttctaatctaagccactacttcttcagaccttaggattcaagggaagaagaaagctgtggaactcaggagacaagacagggtcatgcaaggaaggcttcttgcttgaagagaggtctaataagtcccaaggtggcctctttgccgaagtacagattctatctacacatcggaactagaacatatttgccaagtcagaccaaggtttttccaggaactttagggttaagcattaggtggatgtgcaccaaaaatactggggcagcacaataattcatgtacgtagtcaagtaatatttatttattgagtacctgctacatagaagaaccaactgtaggtactgcctggaatacaaagttatataagacagacctctgccttcaagacatttataatttagctaagaagatgagatacacacaaaagagagttaaactgaagaagataaatactatctgatcccagggaaaagcataaagatgataaatgctctaaagcagcaccatccaatgaaaatgtaatgtaagctgcacatgtaattttgtatgtcccagtagccatgttaaaatgctgttaaagagggttgggcacggtggctcacgtctgtaatcccagcattttgggaggctgaggagggtggttcacttgaggtcaggagatcaagaccatcctggctaacacagtgaatccctgtccccactaaaaatacaaaaaaattagtcaggcatggtggcatgcacctgtaatcccagctactcgggaagctgaggcaggagaattgcttgaacccaggaggcagaggttgcagtgtgccgagattgcgccactgcactccagcccgggcaactgagcaagattccatctcaaaaaaacaaaacaaacaaacaaacaaaaaaaaaacatgctatcaaaataaaattcattgaggtatctttgtgtatgtgtattctaagtcttcgaaatccttacacttactgcactggacacctttcaagtactttgaagccatacctggagagtggctacacgattggacagcacatacccaagatattaagaacaggcttccttggtaacatggagcctttgttggatggaaaaacaaattaacttgtcttcttagaaccagctgccatagaggtcagcgcaacctaatcaggcactgattccaacaaaactaccctgcatttaccaaatatactgatgaaagtaacacagtccttggaatttggttgatttaggttggaatctcacaggcagaacttttttctcgggaaccgtattcataagtgagtagtttaataatgggttgactcagcaggtctgcggtattcaagccaagcatgttccaagagagtgtctggtctttgactggctgctgggaaataatatctaagcccttacaatattctgcctgataggagtgtctctctctcttgacctgagatctttgatccatgccagatagtctacactaacaatgcagtttacagtggggacctgtggccaggctgcatctggttgacttcaggaagggctggagtctgagtaactaaggtcagccatgcaagcattccatgcttttgtgatcaaccctcaataaatccctggacaccaaggctacattgcatttctttggttggcaatattccattcattttgccaaatgtcatttctgggagaatacagtgctgtccttatgactgcaccgggagagaacaatctttcccaagcttttctgagctcaggatttatacacagtctttcctaagctttgccccacatgccttttatgggtgctaactttaatctacatctaccccatcactgtaatcaaccctaactgcaagtataaatgcttttctgagttctgtgagtccttctagaaaatcattgaacctgacagtggtactggagaccaccaactcaaagcttctccctcttgtgatgataagcacagtaaacacaataataaaacctgtataaatatccctggacacagatgtgttagtttggaagagtcagaaatatatagaaatcactgtctcactttatcagggcattatggtacctgcttatctaggaagagatccagttccctccaatagcatcagaatctcttaggcagcaatctttagcttttacaaagggtaaattccttcctaggatcaagcttgaaacttctttacatgagttataataggcatgtggctagaaactagacaaatgccactcatgatccagttccctccaatagcatcaaatctcttaggcagccagcctgtaccttttccaaagggtaaattccttcctagaatcaagctttctatgagttgtaatagatatgtggctagaaactagacaaatgccacttatgatataattagtgcatttcattgttatctttcttcacatattttatagcccccaccgtttttttttcaaaattaacataagaagtttattgccttatgtattcttactttgtactgtctcacagaaaccagtacattaccaacaaattaagaaaaaataatagacattccattccatttttcattattttattgagcaattaacactgttattcaatgaagaaagccaaaatgcaatctggtttgcataaatatttcaacagagtgggacagaagaaaagtcagatcccacatcatgagtgtccccagttcattgtgaaatacacccacacagatgaagacatattcttcgtctatggtgtccccatggacttccagacatatggactagctaaaaacttttggaagccaatcaaatctcaagtctcaaagctgtactctacttgcattggctttctctgtctgcaagggtctagagaccaaggcactctacctttagccttcactctttctcagactccgctgcttttcacttctctctcatcgttcattcaaggagacccccttagccttgctataacactgattctcatttctccatgttgatatcaggattccatcctgtctgaattatcttcctatgtactccctgtttactcaaattctaatgaatgtaacaggtcgggggggttacttaagagtagggtataagtttactaatatctgtgttctcttatctagtgaaatagtcttcaatgcatgtgttaaaaggaacatgggtcatatcaaagcagcatgcagtcctacatgtcatctgtattcttccttaataacctcactaacctccctcctttccaggccaccagacactaccaatctgatatatctttttattttattttattttttaatttgtatctatctatccatctatctagctatctagctatctagctagctagctatcgtctatctatctagagatcagtttatggcgctggctaatttttgtatttttcgtaaaaacaggattttgctatgttgcccaggctgatcttgaattcccaggctcaagagatccactggcctctgcctcccaaagtgctggaattacaggcatgagccaccatacctggcccaatttgatataccttgactagtgattgtgttcgagaagcacttatgaactatattctatcattcttctaatcattttacatgggattgtttatatccaaataatattgtgaatttagtgaaagaggtcatctttaacatttatgaaatataagtattagtctctaggctctaaaagagggattggcaaactatggcctatgggcccaatctatcccatcacctgtttttgttaataaagttttatcagaacacagccatgcccattgtttacatatgttctatggctggatttgtgctacactggcagagttgagttcagactatttgacctgcaagggccaaaatatttactatcttaccttttacagaataaaactataccaacccctgctctagaaaatcatagagtaaaaggctcaacaaatatgtattacagataattaaacatgctaagcatagtgttttagaaatgaaagaaagaacaaaagaagaaggaaggaaaggaaaggaaggaaaggaaaggaaaggaaaggaaaggaaaggaaggaaggaaaggaaaggaaaggaaaggaaaggaaaggaaaggaaaggaaaggaaaggaaaggaaaggagggaaaggaagggaaaggaagggaagggaaaggaaaggaaaggaaaggaaaggaaaggaaaggaaaggaaaggaaggaaagggaagggaagggaagggaagcaaaggaaaggaaaggaaaggagggaaaggaagggaagggaagggaagggaaaggaaggaaaggaaaggaaatgaaaggaaaggaaagggaaggaaaggaaaggaaaggaaaggaaaggaaaggaaaggaagggaaagaaaggaaggaaaggaaggaaagaaagacaattttaaagtaagaaggaaccacctctgggcatatctactcatacctcttccctaagactccagaagagtagagggtcttgctgaaattcacccagctagatatcaatgtggattagcttagaaagagcccctaatcgttcaccagatatcatatatctggtttatcatatatcacatggcatcaataaggaggagcacttccacaatattgcatcccatagttttatatggcatttaatatcttccggtgaaaatgataaggacatgcaggaaatcattaccctcttcacaagttgagtattttctacactttcacacaaaatcgttttgaaactccagctaattactatacttccatttcctctgagggaaaaaataaaataaaaagcaaaccttctggaattcctagcacagcctattagttaatattatctacagtcccataaagtcactggcctcacccccaggcttgctttggtatcagcagccccaagtcaaacaccaaagatgttaaactttaaaaaaagaaaaagcacgtgttaaaaaaaaaaaaaaagaaacaaaagctgacatttatggtttcagggtttttatttccaacagaggtggatttctgccacggcccagcaacccccagagagctcagcatgccacacctccaaatcaccagcctctgcaaagacaggttcataaggcaatgaggaaaataaatgtccttccattggctttgccctttttggtgtattttggccaatctcttcatgctttcatttcaaggtactaacctgccaagacccataagccagggggtataatagtcactcttgtttcccagcgtgggacgaagccatcacatggacaaactagaaagctgtatttacagccccactgacttcctgggagagagttgtgaattcaatgtcacagtctcatttctaatcttgtttccaatttttcttgacatgtttatattctcatttcctgatgtgtgccaaacagcttcagagacccttcctgctctgggcccagttttcatggtgtttgtcatggtgaactttaattatttgcttgaccccattaatgtttcttcactagaccgtctgctcccaggcacgtgacagctgtttgttcattcaagccttcgggcagcaaacgtgtacctactctgtgcctggtcctgctgtagacactacagacgctgcaggaaaacaagtagagaaggctgttcctctcattgaatgcttatccgaatgagggaggcagaatcaatgaaataaggagtgccatgatgtaactaaaacagagtaactttgtagagtgtgacttagagcaacatggtagagtctgtgaggaaggccagtctgtgcaggtaacatttaagctgagactggaatgacaagaaaaagccacatagaggtctaggcaaagggcattccaagagagggagttgtctggggaaaggccctaagctgatgatgatccagggcaaattaagcaagagaagcaggacaggagtgtaacgagagacaggagaggagaggtgtgagggaggtagggccactgcatgcattatcttgcaagtagaggtaaaaagctttggattttattctatgggagaggttggcaaacttgttgcaaaggtctggatagtattttaggctttgtgggaatatagtctctgtcataactactcaactctgcctttgccaccacagacaagagtgggtgtggctgggttccactaagacaatattcacaacgacaagtgggaggctgattcagcttgcagctatagttttgccaacccttgtctatggcactaggaagccaaggtatgtatatggaacagtcaagggggaggcatgagctgcgtggcattttttaaaaactcttaggactgtagcatggggaatggtctgcagaggatggagaatgcaggaaatgggatagaccacagtggtctagagaagatggaggaaaggaggcagatatgggaagcattttgaactaattgattagggaaataaggaaacgtgagaaactgaggataacacccgagattttcactagaacagctcaatctatggggtgatttctgagacaggagagatggagaaaaagtaaatttggggaacaatccaatagttctttcctggatgtctacgcggaggtcttcactagaaattgcaatggagaggtgagtaaggtgggaacagagaagtcctggagctcagaggggctgggcagaagataaaggtttggtagccctcaacataaagatgtcatttaatacggtgctagaggtgacatcgaggtgaggaacgacagaaggagaagaaaatggccactcattactgagagttggaagaaagatgtgtggagtgttctgcattagaacaaatgaatgcatgcagaaatgaatgaataaagcccacatccctgcattaggagggtcatcttattcctctctatctacaacctctatagttcactgtagaatttcagagcgatggctatgacgattttgatcttagaatcaatttgattatttaacgccatccctgatacataacccatttatcttcatacaggcttttaaggacttcccaattggattctgtttctactgacatccatataaattggaacctgctccttcccttcaattctttccccagaagtgagagctgatagccccaggtaagtccccagcccccactgaagacgcatttcttctctgagggttaccttgagagacagaggctctgttggttatgattagatggtttactaacataattgtgaacataatttgttctgatctgcttctgccttccagtcaacccacgttccgtatattagaagaagaaagggttggtgtgtgtgcatgtgcgtgcacacacacaagtgaagagtgtttagttctgcctgtctgtgcctcagggaatggaatgtaacagatgttacagtaacacacattttttgctttaagaaaaggatgaaggaggtggagtgggccaacttgtagacactttggattccaaatcaaaccagaaaaaaaagaaaaggctgcacacagttagaagaaagtgcaagcggaaaagaacccccaccaagttcaaagggacttgtgtttaatcagacaaaaacaatttttatagcctcgggagcccgtgtggtgtgtgaggaagttgtgcagcaggatggcattaggcactcaagccagcatgcttttgtgttattttcttctttctttgtttgcaaccggggttcaaagaaattcactgtgcaaaacagatactgaagtagatcatacccacgaattaacattgtcatgacaagcagctctgtgttatgagcaaaattacaagtgacccatcaaataaagcagttattgtctaagtaagagctcctttcttccaggattccaccgtgttgctagctttgtctcttccactgaaacgctcatgcacctgatatgaactccaagcagcctcctgaacatattcagtgagcctgacttcaagagaaagccccgaacgatgaggaattaccagcttgcaagacatagagaacccattccttctgaaaaatcattttccttcctgagcccattcacacagggctttgactgtttcctacctgaaggtcacatgcatggccaaatctccatctcattaattacaactcttggcaagccattaaaaatctcatttcattttaccatccaacctccttttaactgacttttcataattataattctatttttgatatactggacctattaaatttaatgccatacagagattttagaactccttaaaaaaagactcaaattggactgtgtccaccaaaggatgtgtagtccttgcttaggaatatgaaaggggaaaactgcagtgcattctattttcatccacagaggaagaaaagtcaagctaattgcatatggtcagtataataatgctgtcattctagaagggctataattagcgagaattgttttcacaaacaaccgaccaagcccatgactccagcttgcattagttcttttttccccaccagttataaacatttctatttttgctcctccccaaacataaacattactccattaaaaatacccagggagaggagatcctgacagtataactgcaaactctgggaatagacataagcctttttgcaaatgttgagtctgttaaaaggattagagtgccaagagagggttggaggaactattatccaacaagctaaactttacctggtaacatcaaggcgggaagccccaggtgaggcacctctcctggacagagaggagtgagcactccaaagccccatgtgaagatgaggggccattgggatctttcacatctgaagatatataaggcaaaacttacttagctccacgtcatgtcgtacagtatggatgaataactatggacaaaattctctctcactttaaactacagttatttaacaaacattatttggacaggaattatgatcagtgcattttccagtgctgaaattcaactaagaaacagggattgttgaattttgtcacactagactgagacagtggatcatctggagtatctagcactgattctctccccaacatatgttcagagtcctgttgctccagcttctataacacactttcttctgtccccactgctttttgtttggaccctccatacctctcattccatcactggttgtccacctatgccaagtctgttccttggtgcctgggcgctccagtcagcatctctaacatgaaacctcaataagaccaaagccactaagaaccacactggctccattttaccttcaaacccattttcagtgctgtcccttgtgcaattttggttctaactgtagtgagtgcttttggtccagggaccacccagagctcccttgacttccctttccttacctggtggtctgacgcctgtcgttctgactccagctgggatgacagctgccacagaacctctctgtgcatctccttcaacaagaggaagggtcttccctgtgcacacagtgtccagaccttgcctctcaggtcctatgctgcagcgttcaatttgtctattgacacatccatctttccactaaatggcaggtgcgctgctatgtcctacactcccagtgcctaatgcaaaggctgccctgatgcaggcacttgataaagatgtgattcaatgaatgaatggatgtgggttcaaagagtggctgaatgaataaatgtcaaacacattgatgaatgaatgaacataagtcattcagtgcaccctctatgttgaaagaaacgaagctggaaaataagacaaagcttgggatgctaggagagagttctttgaactacatttggagcatacctgtcctctatgctatgacaaatatgcctggaatctagaaaaggaggctctaggttgaggcattgaggtacatgatgagataattttctctcaaaattttttgattcaaggagcaaagcactggttcagaccctcttgcaaagacagtaggatgtggggctatggaaaaactcaaagtgaaaaaggtgagcacatacatgttaattagggctcagtccatttcctctcctagacaggcccccagatcctcagcagcagcacccaaaccagacacatacacactcacggacacacacacaaagcaggaataccacagtagcagctcctccccccaccagctagaggctgcagaatatgagaacctggcctttgcagtgtaacaggccaggaatctagcctctgctctgttccataagcaccatgggttcatggactagttaattaaattccttagtttttttcctcagctacataaaaggggaaaaatagtcactttatacaattttataaagactgaatggcatactgtatgtaaggcactcagtaagcatttgttgttggattgctattgtgaggcattgttgaacttgacattgctatgctcagcttggcttggtgtttatccagtagattccctttataacataatggccagaataaaggaatggccagagaaggaatttcctagcataaccagactgaagctgagttgatgataggttagacatctatggaatctgaaatgagtcagtccttcctttcctgaaggtcatgatgtaacttttgcacctataataactattcccctacagctgattttgctggtttttaagtcaaaatttaaccaattccaattaattccgtctttatatttgccaccactccatgttggcttgttaggcaattaagtattcaaattagagtaactctcaaatatttccttgcagaggaaaaacaaagaaacaaaaaactatgaaaaaaattaccctttaaaggcaaaatgtccatccagttttgaagattaagaaccactggggcagaagagggagaatgacctagaattcagaactgcaatgataaaattattcctttgacaacactaggtggctgattctcctaaggttgtctaatagatttaaaaatttttgctatccttgttttatggaaatataatgagaaatatagacatggttttgtttagtttttaaattcaagataaacaagaatttcaactgtgacattatctctcagcaatagcctttgaatctcttgtgttgttcaatgaactactcactagatgaaccactggcctttgcaggtattaacctctgcagtaggtcatcctacttcatctgtactgttagtaaattaatcaaaagctagcatcaggtatgcacacacctgcagagataatgtgtacagtgttctccagagggatgggatttgattctgtaggtgacactgatggaatacagcagtcagggtcttaagaaattggatagattaaatatatcacaaaagagacattttaatagtctaaaaatcagtaaaggtgtttttcaaaatacatataattgagaaaatatacactaccctaaagagagagtagattatgagatagagatgcaggaaagaactatctcaattgtgtcccccaaagcaaataaatttttattaagtccagtaccttgctttttaaaacaacacgatagcttacaaaagaaatgaagctttagtacacactcttggaaataccttttcagatgatggtgaaaataataaaactgcaatgaaaataatgacacccataataggacacactgggtgcatacaatattctcggcactaggctgagcaacacagtgggtattttacatacacattcctgaatccttgaaaaatccatgaagccatgtattagtacttacattattcatgcaagaaaactagaactctaaggaaaagcaagaaacacaaacgattcttttcattttataattttctttatcagtctgtgatttatcttttgaatgcctgattttctatcttcttcatcctaggggagagagtattaagttctttaacagcaaaggattaaaaacatagtcattctctccaccaagatctataaagtattttttaggggcataacaataaataagacagaaatcttgccctttaaaaactcaagtctggccaggcgcagtggcacatgcctgatatcccagcactttgggaggccgaggcaggcagaccacctgaggtcaagagttcgagaccagcctggccaacatggtaaaacgctgtctctactaaaaatacgaaaattagccgggcaagttggtgggcgcctgtaatcccagctactcgggaggctgtggcacgagaatcacttgaacccaggaggcagaggttgcagtgaggcaagatcatgccactgcactccagcctgggcaacaaagcgagactctgtctcaaaaaaaaaaaaaaaattgcaaacaacaacaacaacaaaaactcaattctatgcagcatcacatactttcttccttaaaaataagacaaagacatggttctgttatacagaaaggagggaaagtgatgaaaattataccagcattaccgccattttttctgtgaggtaggactgagtcacatatatttttatatgttgtgagttctagataaatacttaataaatgtcttactctgggtttaaatgtgagttaatctgttcctccctatgcatcaccttctaagagatttcctcagcattttcatccacctcataatgctctttctcactacgtctatactctgtctcatccacatcatgatcttttgctctgaccatattgatgctactaggttggtgcaaaagtaattgctctttacctatgtatctctttaaacactttcaagtctgttgggagttggtctattttgcggatctagggtccaaattctgtcactgattgttctgctgatgcgcttagttccattcattgtttcattagtgggtaccctttgacttgagttcaccatcaccaagaagctgtgtttacaagagccccaaatccagaactgagaacactgccatgggcatgaacactagagggcgctctcaaactcgaagatttggtgttaaggcccctgctggcaaggaaggttcttatttgggtacctcgtgggaacctagaaagcaggcttgaggccccagtttcgtcttcatgagacaatgtccacccacagccatcttcctcttctcgtcttggggggtgaatctgcggttcttttgcgttttccttttgcaggtagaacagctcactgtagcttccggattcagtttctggcctccctgctcatcaggctcaagcctcacctgcttctcccatccctgagcatgtttataagccccagcccccagaggcatttcaacttgggttcctactgaggattccagacttgacctctcttttttatttctgtcccctggaactgtccctttcttgctttggggacgctattttttaaatgccattatatgagggtaagagatttcaaccatcaactcggcctactgttttgctggaaatcttacaaaagaactatcttctgtatgttttcacctcaattccagagtaactagaaatactaccctacgagggcagagacacttagtttgaatgcgattccaatgttttcatgctgataaatatgaacattttaaatcttaagggaagataggtagttttaagtccgtcctttcaattttacacctgcatttaaaaatataatttaaactactatttaaccattaattatatcccaaaaaaagaggatatgaaaacccgagtgaacacagttaatgtacttgcccccatggttttgaaacccagcccacacacttcccaaactctgtagtatgctctcatgtctagatgaatatcaaatgtaagatgatttctatggttaggagctgagttgaaagcagaaactctttagtcttcaactacaagtttcatttttttatgtgcaaaagtgtctatctgcaaatgcacaaatgagaaacaacagactggctgaaaccattcagcaccacacctggctcctagggagtgttcaggatttctcagcgactgcctcacctcagcataatatttgtaatgcgtcttactttttacttttgagtttatttctttgaatagggtcaggaaaatccattaattaaagattccaggactctaaagtacatttcaaaaaagcagaattgttcatgagatcttataaccatcctaggttcttcggatattactttgtgtggttatgtggccagaggagtttggtctcagactataaaaggcataagtctttctaatctgttcataaccaaatatagcacacaggaaatcactgcaaagcgctgatataatcttttctgttttactccatctgaagatggttcctgcctgaaccatgcacactaatcatttaatgttctacagaagaaaagaacaaacagagcagggaggcagatgtggccacatactggatctacacttaaaacagtgaatggctgctacccccacctcctgcagtaggtaagggggggtcataattacatggtggggtaggaatgggtcaaaagcaaattgcctgagtgagagaagttctagaaggtcacatggtgagactggctgaaaagtacctccagaactagcaaatgttttcacttggcttgaagtcacagaaagagcattgcagcataatagaattacacatcctttgggagatatccttctctcacttggagtgtgaaattcttggtgatatcaaccgaagctccacatagttatggaggtaaaggaaactggaggctttgagaattacaaaacataccacagatggaatattatccaactatatttcttgcctcccctaaacatcagttacacggttctgtcaagagactcagagctgccaagggtcagttgctcagttgtagcaaaaactattttcaattcatggaatggcatgactaaatcaaagaaaaataaaataaaaaggcatttcaagtggccagaaaacatggggcatatggaagtaggcaggcgatgaggcaggatgttcatgggagaagcacagtatttcattagctcctttaaaaaatgttgctgaagaaacctggggtgctcaaatttggctcagaaggaaggggaagtcttaaataagtatagtaatgataaacacatgcaaagttcactataatcttcccactctttctttccttgctaagttaatttttcttatagcaggcatctttaacaaccatgtaaatttattattttcatatgttctttctttattctctctaaattccaaagattgcccttaagagctttcaaaatctgaattaaatcagagaagacattgaacaattttgtgcagacacctttgagagtgaagaactatatcttataaatggtgtgaataatgcctttggcccttaatacaaacttattttatagccctgaatgtaattcctactacatatctatattagtcaggcttcacaggtctagatgaaattcttttcatctaatattttcactgaaggagcatagcttttattcacaaggaacatcctaataggattttaaagcttttcccaatgagagatggcttgcttttatcatgctccttgaggagaaaaaagcttaagaggtttcaaataaacagcttatcaatatcaaatattatttaatcagaccaaagacatagttagattaaaattataagaaggacaaattattgtgcaccagctttcataatttttaattataatttctacaattttataacgtgagttatttgaaaacatacttagctattcctaaagagagtcaaattcccattgttcatctcaaaagtcataaaaagcaccaacagatccttccattctcccaaacttgttgtgactcatatttttgaatttcgagtcattcaatgtcttctaaaatacaaaaaatatattaaaatgaggaattatttattttcttctttgtatctcagaattgattgggaataatttgcaagggttgagttttctgtttcttgtcaaaagagtttctgttcagctatttaataaaacatgtattgagtactcattgttcagaaagagcccttatgtaaagcacaaggtggagtatacattttatttactcaccagggttttatcacaggggagacagacatattccacaacacatatataaggatacccatttctgtgggcagatgcattagaaaatatacagaactgacaacacagctgaggagaaagctaaactaccgtagtacggatcttccttgctaacagaacctgattttgttaaacaaccagggctggagcaagggcaaggctagtaagtacctcatttggagtgtaaaatttcaggggatcaaaaaatttcagtaatcaagataaataatattttaatataatatttttcaaggtctagattaatgcaaaaatccaggaggagcaaaccatcaacattttgaataaagaccctggagccccaatggggctcggcaggagactgtactgatcctgtctttatttaaaatctagagtgctgttcatcattgcttgatttttttgcattcagatagctttttaaaatattgcattagtatattatttatcttgattactgagtgtttcagcaccatttaaatagtgtacccaagatgagttcctcactcacctaatcctggtcccaggcctgctggactcaggacataaatggtggtttttttccattctcccttgccagacacttccttttcaattacacctagaggcagccacacaaatagctctggccattcatatgcaaacaattctgcacatggcttcatgtaagatttggcttttgttgttgatttctgatactaagcagagagcaaagaagctggttgcccccaccctcccactactgcctgtctctgaacactgccagcagccatcctaacatgaaataaaaaccaagggcaagagccaaccccgtgaggattattgagcaaaatgacagcacttgggtccttgctgccactgttgagctctgaaccagccctgcactgcttactctttgcatctagttaggagacaatgaacatccttatgatataaaccacaattagactaactatctattacctgaagtcaaaatatttctaatggatattctagcttaatagccagtgagctttcggggtaagggtttctaaactttactgcactgatgacttaaaacatgtatgttaatatttcatctctgaatcatttgcttctaggtagtgaagcagtgcaaattctcaattggaatatggctgtaatctctttatatggcaattaattgtggaaatgtatgcaaattggaggtcaaaccatcattcaaataaaatatactgattttttcctactaaatatttgtgacaaaaatgccagtgtcaataatgtcaacagaaatctccatttttattttgctcctgcaataaagaattctttttttttttttttagatggagtctcgctctgtcgcccaggctgaagtgcagtggtgcgatctcggctcactgcaagctctgcctcccgggttcacgccattctcctgcgtcagcttcccaagtcgctgggactacaggtgcccaccaccacgcccagctaagtttttgtatttttagtaaagacggggtttcaccgtgttagctaggacggtctccatctcctgacctcatgatccgtccgccttagcctcccaaagtgctgggattacaggcgtgagccaccgctcccagccacaataaagaattctattgtgttgttgtttgaggatgaagaaaggagggaattttcctgaagagataaagaatgtcccaaatgtcccttatgttcccttatttccctagtttcaagagcaatagaatcaatgtggtaggaaccttagatatagtagccctatgggctcatttttcacttgaagaaattgagatgaaaatggaacacaatagattttctatacatcagagaagcagttaacagcagattcacaacaattgcacaggtttcctttcctagtctggtattctttaaacatgaaccatgatgctttccaaaaaattgactcagagaggaggccaaggcacatgagtctctgagcagaacagcctacatcgatcttcgttaagtgatgctggaaggcaaaggtctataattatgctatccaatatagtagacactggcaataaatgactacattttaatttaactaattaaaattaaatacaattaaaacgtattactttagaagtaacatttcaatcctcaacagctacacatggctaatggctaccatatttgtcaatacagaatatgagcatttctatcatcatagaaagttctattggccagcactgctttatagccatgagttctcttattgttctgtttctaattgtaggaacaggaagaaaggaaggatcacctatagaaaactcaccctgaaaaggtaaaagaagaattgcatgcattactacaaaagctactcaggctaaatatgtatctctcttatttcctctccatggttaatataatatctattattccaaaaagtatttttatcacttaaattcaaaagcaatctgaaaatcaacaattctcaaatgtgatggcacctctgaaagtggtatactcagaaattttcctccagactgcctttgggagttaaataaattaactttcttatgccaagttaacatgaacttagcccttaaaataactttgtgaggaaaactttactgataaaacagtctgatatagtctggttgtttcttctctccaaatctcatgttggcatgtggtccccaatgttgagggtggggcctagtgggctgtgcttggagaatgggggaagatccctcatgaatgatttggggccctctttgccgaaatgagttcatgtaacatctggttgttaaaaaagagtctgggacatctgccctgtctctcttgctcccgctcttggcatgtgatatgcccatacccccttctccttctgccatgagtaaaagctttctgaggcctcaccagaagtcaagtagatgttggtgccatgcttgtacagcctgcagaactgttagtcaaataaacctcttgtctttataaattacccactctcagatattcctttacagtaatgcaaaatgaactaagtcacagtctatggtgggttttcattaaagataatcttggatttcaagtaatttgctgaaacatgtacacacacatacacacacctaggtcttattaaatgttacataacacattattcagaattatctttcacattgtaaagttctcacataatgcttggacgtgatgcccaaaaatatgtggcattgtatcctaacaaactcaggctatttctaaagcaatatgattactggatttgacactctcgacaagtttatgcatcctcatttgagttgggactaacgtaatttcaaaaattggtttcatagaggtattatttaggtagaataatatttactcatttaaatgtaaaatttaatgacttttaacaaatgtataaaacctgtcaccacctcttcatcttgatatagaatatttgcagcaactcaaaaaatctctcgtacaccttgcagtcaatttcttccttgaccctatatccaggcagccattaataggtattctgctgctacaattctatcttccacagaatgtcacataatgagataatgaatacatattcttttgtatctagactctttcatttagcatgatactctgagatttcatctagcttgctatctgtatttgtagtttgtttcctttttattgcccagtagttctccattttacataattaatttattcatttccattgatgaacttttgggttgtttccagtttggagtttttaagaataaagcttctataaacccttggatacaaatctttctgtagacattattcaatattatgttactgttgggaaaatacctaggagtgaattttctgggacttattgtaagtatatgtttaacttttgaagaaatgtcacatttcccaagtggctgaatcattatgcatcatcatcctgcattattaacaacaaaacaagaggtccagttgtgccatatccttgccaacacttggtattgtcagcctttctaattttagtcagtctgcagtgtgtgtggaggtatctcactatgcagttatgtctaaattgctagtccatttttaaaaattagattgttttcttaagttgtaagactttatatatgctggacacaagaccacatatatatatggtaaatatgtgtatctctgtgtgtgtgtgtatgtatgtcaaatattttgcaaatattcccacacagtgtatggcttgcttatccattttcttaatggtgtcttcgaagagaaaatgcttttcatttgaatgtggtccaatttatcaaattttctggtatgtgcttttcatattctagctaaaaaatctttcctaattcaaagttttggaaatatttcttatatgttttcttccagaggtttttaaatttttgctcttaaccttaggtctgtcatccctatcaggtaattgttgtatattgtgtgaagcaatatttagagtttactttttgcagagagatataccatttttccagtaccacttgttgaagactactattttctcattgatttaccatagcctcttcactaaaagttaattgacaatatatatgtatatgtgggcctatttctgatctctgctttctgttcattgccttatagttttcctcatgcaattacatcattgttttgagttcttgtagtgtaggtcttccaacatttccctgcagaacaaaccaaaaaaaaaaaaatggcagtgcaggagcttagaggcatacctggttatcattatgaaagttccatcgctgatggaacatgtgtgattagatgaaccccttccttcacttaacccattccctgccttatatttttcctcaacccttatcactatgtaaccaattctactacatgtctatatcttattattgtctgactctcctaataaaatgtaaactcagtgtgggccaggatttatttctgttttacttcctggggtaaccctagtaactaaaacaatttctggcacataataagcactcaataaatattgactgaattattaatgaactgggcctctgctttcatctttaaacaagtaattctctgtgctgaagccagagaattgagtggcacaaaaaatcaaacatacaaatgagaatgacaaccgttaatcaccttctgagagctgccatgagcactctgctcagccgttcctggcgtcagggtcttgcttcattgattttagttagcagggtttgcagcctctctaaggcacacccagacatattttcaaggtaggatgggtcaaatagtgttaccccgactttttacactggggattagaggaatccattcattttggtgctttagcacacaacatcactgtggatgacagcatgagtctggcaggctcttaatcatgaataagaacactttctcactcatggaacatgtgtgattagacttgcccctgagtcatatgaaggaattgggagagcaaaagagaaattaaagaataaagctagagattacctcccagcctctctttagtcaataataaaaaagattcaagaaaatacaaatttaaagtgttgattaaattaaaaaccaaagtaaataagatttggaaaccttcatgcagtctttttctgttgttttgttggtaacagagagacatcaccactgctatccactggagatggcataagctttgtctcccaaatgtaaccaaggtggcttaccttgtgctgatataaagagaagaaaggaggacataatccaagaaagatactgcctaattaaaactttactcaccccacatttaatctccaactcttcctctgtacataaaataaggatttttatctaccttcagtatgacaaacagatgaattgcccatttaatgcttagaaagattataatatacttaaagatagataaaatacaataacgtaccatttgaggccaaatggaaacactattttaaatcagaattctaacagtaactttacaaatccttattcccagttttaactcaatcaaattgcacaactttacttacaagcaatccactcaaagacttaaaataataaaaactatctccctattgagataaatcaaccaaaaaacaattgaaattttacctgaagataaaatataaatattcaatcttataaattatttaattagtggccctagaacgcaaaagtaacatgaaagttattaataattttcaaaactcaataaaccattttcgtcagtctaattattgcttataaaaatgcacaacagggaccctctcaggtctcatcagccaaagatcaataacaacattaaagtccagtctaagtattagaaccaattctctttgttaataacttatagtggttacatgctgcattttctcctaacatctctgtgcactcatgaataattattacatacctagattatagaattgaaaagtggttttttaaaaatatttcatttctccagatagaaaactgacaatatattttaaaatcagaaatgtatcccaaaatgcattttgtaatgtaaaaagcaggcaatgtggttataccttagctggttcctttgcaaatagattaaaatattttgccaatgtgattttgacattacatcacataaaacatccagtcatatgcatgataatgaaaagacaaattattcatggaacaaaggatatttaaggatccataacagcacgtttcctccccaagtaaactcttaagaggataagtcatatcctattctgaaacaagtgaagatcacacttggtttatgtaaattttagtttacagagaaaatgttgagttcaagacagttttcaacagttagcagtgtcttcctatatgttaatcagattcatatgaaaatgttaaaactaagtattaaaattaatgtcatgctatctatttctaattaaaataaatgttcttaattcctccttggagaaagtaggacattatcatgcaatcacacacatttatgatttctaaaggtcacagtggtagatctgagactagatgaacagagagaaatactggaagcagttttacccaagatttatatattcagactcagaaacctctggaatctcacagggactcgaggaatcctctactgcagcctgtcctgtggcaatgaggttgctgtatcctaatgaagaggctaaactcagccagtaccatgactccacacaactgcttggtgcattagacaccagacagccaaatcccagagaagaaacagagcatcatgagacacgcatggagccatgggacacgcatggaactgtgggacacgcgtggagccatgcggcatgcaaggagatgtggacgtgcatggaaccatgggatatgtgtggaaccatgggacacacatggagccatgggacatacatacatggagttgtgaacatgcctagaactgtggacacacatggagggatgggatatgcatggatacatggacacacataaagacatggatatgcctggagctgtgggacacacatggaaccatagacaagcatggagccatgagacatgcatgtagctgtgggagacacatagtgccatggcacatgcatggagccatgagacacacatgcatggagccatgtcacacacgtgcagccatgggaggcacttagatggcacatagagggagacatggatatgcatagagccatgagacacacatgcacggagccatgtcacacacatggacctgtggacacacatggagcctagcacagaaacatctccttcactcatccagcatgccttcattttctgagaggttacagtttgttgtaccttgacactgtccgtgttacgccttctccagccgcaggaggagcaggtggcaggctgagcaatgccagtggcccacaagacagcacggggtcaagggaagagtgacaggaggccagaaaacaggcaagaagggcagttatgatgacaacatgtaatatgcacatggccacattagagaagggcagaaagagcttcttagactaggagaggggctgggggcacagtgagtgaatacgagaaagagccaactcagagttacaaaacatgtcagatattcttcctgtcaaaatttaacaaagcaatgcatgcaacacacacataaatataatgtaatataatgatatgttttgaaaggaaaatataggatccatgaaaaataatcattcatactgtgatatgggaataaaacccaagtttaaaatcctaattggtcactttcagtcactgttttttcaatcatctaagactacatatggggataaaggcagctgttaaaacccaagttccttagggaagcagcagaaaaccaagtgcaaccccctagcccagtcccggtgatggcccaagctggagcagtcatctcaattccctccatgcccttcccaagccactggagctaaatgttgcaaatcctctatcacgagtccatgcagctcttgcttaagtttcagaacaattctcaggccaatcaataaacccataagtaggaggacactctacaggaacattaaggagttaaagataaagatcgctgggacctgggaatggaaatcaatagggccctgcctgattctgcaggcaggagtaatcttaggcattaatgctaaatgctgccagctaacaccctgaagaaaggcctccaaatcagtcatatgaaggacccacgcaaagtacagcatgactcacatcactggtggtctttctttgtgaataatgtgaaattgcttcccacaaaccaattcctataacaggagcatgctctctaaatagccagcatactgagtaaactttaatcaataaacaaacaaaagcagaatatggcacattgccttaagtagacattaaacatttaaaactaatttcagagatggttttgagactcagtaagcatgctgagaaacatgctgtcttgaagggtcactatttttcccctctttattggaatagacatttaaacaaatgacaaggacatatgtgtgaacggtgcatctgtaatgggtcagggtgttttagcagccactgcacaatcagggctaaatattccagaacacagagtcaggcaagtaaccttgcaaacatagcaagctgttaaagcgtgttatgcaatgaactccactagacaggaggagcctgcagtggcaaatatttcacagaggctggaaaaaaaaaaagattctaccagcatcttctgcctagccaggtaaatcagatcaagactctgacagaacatgctaagttgcatgaagacgttccgttaccatccagtccttcatcagtagcatcctatgcagaatgcctccagtgcataatactatctgcatggaaatcaggattttaagtcaagattatccggttctccctttatttccccttagtcagtgtttcatcctactttctcaaagtttcttggaatggtgccttacaaaaaagcgttcacggggagtcgcagagaccacttgttcagctgtaacatgagccatttcaaggcctgactgggtgcataacatcacaagacatcgtgtgtgtgtgtgtgtgtgtgtgtgtgtgtgtgtgacagagagagagaaaaatagttttattccctcctcagagaagcacttcctttctaaggccctgtactcttggcctggggcctgcctacccctcttcagccaagacagagatcttcaggaactccttcctctcccgcacccacccccacccacaagctttcctgcatcctgggtgctttggcctcctgccctccaggctcactggaggtggagttggcttcctataactttactgggcacctgttcccagttgctgtgccctcctacagcaccggggtctctgcttaaacaatcatctcccctctcttctctctctttagcctcttccttcacctcattccttcccatcgccatttgaggatggttaagtcatgctctttgaaaagctgttccctgccccttatgtccttgcatgactgacatgaattctctccttttatatctatcatctagtccctaacctttgatatatccccacacatatcaccatctggtttcttcccccaaccctgcactgaaactgctccgataaatgctgccttttatgtgtcctcccaaaagatatactgaagtcctaaccacaggtacctctgaatgtgaccgtatttggaaacggcacctttgcagacaaattgtttaagatgaggtcgtactggattaaggttagccctaagttcaacatgacttatgtccttataaaaagagaagacaaaaaggcagggacacagagggaggataccatgagactacagactaagagactggagtgatgtgtccatgagcaaaggaatgccaaacattgctgacaatcatgagaagctaggaggaagcagagatcggttcttctctagagacttcagagagaacacagacctgcaaacaccgtaattttggacttctggcctccagaactgtaagaagagacaattaggttgttttaagccatctagtgtgcagtaatttgttacagcagccctaagcagctaatacagtactgctgacagaatttctcagaaagtgacgaattgtcctggctttcccagaacagaagcaaccaggaaagtcccaggaagaccaggacaagtgtgtcactcttccttctggcatacacctgccttgaacactctgcagtatctgacgctctgctggacatagccttcttgaaaatatccccattcttggttctcagaaaggcttgccctcaactagataattccatctggtggctcacaggaactcagccttttccatctaaaatcaccacacccctcttatctgctttctcttcttgattctatatggaatcaacagccaagaatgtggggattgcagtcagggcttccttctcattcctgctctacatctactgaatcctcaaccacactcctttccaatttccagaatctacttcttctctacatttctgcctcccttcccttaatgcagttcctcctccctttggtctcagtagcagcctcagaatgggctgtccctgccggcattttgtcatcctccagataaaggataaacttattcagatgacttccaatgccaggcacctccgaatccccacttgccatgtgagcctcatgccctccacctcctcctccatatcgtaaaataagatgtcctgacttcctgtgcgtgaggcttgccaggacccgcaatgctccctctctcacttcagggcttatcacttgctcttttcctctccctggaaacctctcctttcataagttttgtaaacaccttctaacaatcacttgggatgcagttctggcatggcttcatcctagaaacctttttcaaccaccgtcctacagcccaggatgtgggcttagagcccctctcctaggctctgcagcacccaacacaggcacctgttaggacccttcacagaatattacgcaatggcccttttggttcacattcctaaaaatagtctaaacccttttaacaggaactgagcatcttcttgatctcctcaatatctagtaaaaaccctgtacacaacaggcttctcttaaatgttcattgaaggttcactccgaattaaaaacatgcaaataaaaatacactgagatgccatttatgcactgagtttggtccaaatcccaaagcctgacggtgtactctgcaggaaaggcggcagagaaataggtattcatatccagggcaactagaatgcaaagtggtgcaacctctatgaaagagaattgggcaacatttacaaaacgacatatgcattcaccctttggcccagaaatcccaattcgaataatctctttcaacggtacacttgcaaaaatattacataatgtttacaggaggcattactcactgaaacactatccatggtcacaaatggcagaaaataacctaagcatctctcagtaaggtgtttttgattaggttagggctcatcacatagtggaagctatgtagctaccgaaaaaaaaaaaaaaaagaatgacatcaatctctacactcttctagagagtaggctccagcatatatcattaggttaaaataatgttacacagaaacaagtctatataattgccacctttcatctaaggaaagagaacataaatatatatttgtatgtgtgtgtgttgctttgcttctattacaaaagtagcctaacccataaaatataggtaaatagctaaatgcagaaagagctctggaataggatcaagaaaacaggaagcaaagctagattcctttgaacaccttttgcttcaataattaaacaaatgatagtaactgggtcttgggttggtgccataaccacgcagaaagaaattatttctactggttttaaagcagtaattttgctaatttcactaaaattttccagtgaaatatatacgcgaggacaaaaaaaaaagagagagaaaaaagtcattttaaagatttttcaataatccaaaacaactaggtttgcatgaagctgttattctaaaatgactgtgtactaaagaaaaaaggcaaagaaataattaggttggtcagcagagacttgagattttgtgcaaggaagaaatagacactaagatgggaaaggttaacaaagaccctagagtcctggagatgagttgggagtatcaggagaagtttatggtatgttttaaaaatgcttttgttagcactgtccactgagaagacctgtgggcacctttggtgctcaaagcatacagaaatgagtgattcccaggtctgtggaaggaaataagtaaaaggaataggaacatcttgtcaacccagagagtaaagaagctctcaaagatgacttggatggagtcagaagagtccagaagctgctctcaagaggctacactgggcttaaaatgctataatttcaccatgtacaaggatgtaaactacatggattaaaatacatcaaatatgttgaaattcatgtattaataataattataataatcaaaataagaaaaaggcaaacataacatcttattcatcccctttggatgacaaatgaatgacctgtgggatgttaaagaaccaacctacttgtgtatttaaaaaaaaataaaagtataaattgatggggggcggggaacatttattttgcctttcctgcataaggtgtaccttcaggatacgtaaagagttgatgaaggaaagatagtttatatagaagtattctaaccattaaatgagcaaaataataaaatgagaaaatcccagttttgtacccacagatgaatcagtagattgaggctgtgatcatcaatgactgatcatttcccagctggatatgctctgcctcctgaaggaaatacgctgcactacccatgacacggtcaagacaaaaagatccaaacctggatctcagcaggtgtcttgagattactaggaatttacagacatctttggaaagaggaatatttgaagcacacaatcagaatgcgatgagcaaactccagactgtgggaaactgtccaggacaaagaacttggtttctgtaatttgcaaagggtgtgaaataaaagtaaaatattaaaagagactcaagaaatataccaaccaatggcagtgcatggaatttacttaaatctcgatttgacttaactggccaaaagatgccgaagtatttatgaacccatgaaagatctctcaatgccctctgggtgcttgatgatgtcatgaaatcatttattatttgtttgtttgtttgctgtgataatggtactgaattccttatctttgagtattatcaactgaaatctgatggataaaattatttgatttttttttaatttcctccaaaataatttaatgggtatgagatgaagcatgagtggaaatttagatgaaaaaggatggggatgggccatgaattgataagtgtggggctgcatgctccttagactattctttctttttttgtgctccttagactattctttctatttccatagatatttgaaagtgtttgatacaaagttttaaaaacaacaaaatataaaaccacttgttgcatgaattactgaaatacaatgtctcattcatcatatttagcctgataatataattccttgaggacagagatagagtctattttcttttccactctgaatgcttgagtgccccgggtgtgaaggaccttaaataaatttcaatgaatgaaagaataaatgagtggatatacagattaattatttaatcctaccaatccatagagatacttgggacattaaatcaattctgctgccatgcaatgctagatagaaacaaagggctaggtttgtggcaagactaaggctttgcagggaaatgccatagtgaagaattttaggctttccttggttttgttgttatttttatggtcacatttttatcctttggttcaaacacttaggaggcccacagtacctgttaaataaaggtgaccagaaataatgagatttttttaccttggtaatccctgtcttagatccctcttgaggtggtaatcagtttctggatatgaaattctaatgatagaggcttttgtagttttacctttattttaaactgtgtctgaaacaagagccactggattatacagcattcgtgatgctctattatcttctatcactaaacacagaatgtgcatttagatgacggctttgcaatcagtgcgtgctggttccttacctttataggagatgactggatgctcggttctctggcactgagtcgtaccctgggcctctgggtgggcgagtctccacagccccaggcttgagaacagccatgctataacacaggttcccttcatggtgggcaaggggcctctgactctgggcacgtgtcttctaaacagaagctcttcttctcctcatgtgtggaaagtgcctaaaacacacaaaagagaagaatcagatgactgtgagttcgttttctggtgggtggtcttctggtaaaacttcctcactaactttaaggttacactttgtggagatagaggagagcttggagggcttagagcagcatatttttctagtcatatcccaggtcgtgtgtgtgtatgaatgcatgcgtgagtgcgtgtatctcaatacagacctctcattctcccaataattgcatgacatagcccatttgttttaaacgagaaatgctcaagcttaagctgtactgtcgtcacactcactcctaaggaatgcagattaatagttgggattggccggatttcccttggtcacctgtcctaaccccttgcgcaaacacaggtctatatgtggaaaccctacaaatacctgcccatccctttttaacatttaaaatatttagttttaagaaggccacagccattgtcttttactaataaattgatgaatattatgctgcccaactttaaaaaatcatcacgatttgctaaattctgtatttagtgatgcaggataaccttttaaaattgtagataatctgcctgcaaaatatctggctagagatcaagtgtgaatcaaataaaatctatatcgagcacctactgggtgaaataaaagtactatgcttggaaactttaaagattatgaacaatttaaatgattaacaagcattaaagtaatacaggcctgtaaaaataactataatccaagctgttagcaaacctcaaaaagaacaggagtgctgtgggagtcaagggagaatacgactgctacagagaaggatctatgacgggtccatgcaggggctcaaatctgagtgtaatgctggaggataaagaggatttcaacagatggaggtttctggaaggacgttccgtccccagggaggaggatgaaaaggcacattggaggggcaagaggaagaggtacgcaacatgttttaggaatggtgtgctgtactcgatctaggaagtttaaagggaagtattgggaagagcttacagagtaggttaagatatggaaggcaaactacactaaggtgtgaggtctttattttcaggcaacaagctaccatagtacattaatgttagaagatcttattaatattaataagaccattatcacaatagtgtacctaggaaactaggcagatgagaacatagaaatggagaagtcagtttgaagccattacaattgttaagaagagaaataaatgaagcagtgactttgagggtttcaatgtgaatcaaaaggcaaacatagtacacaataactgtgggtaatggaaactacggcaaattagagatggccacagattcgggcattcctcccattgagagctggatctatgttctccacctggaatctgggttggctcagtgactgctctgctcgctctgctcattttaatacaacagaagtcatgttgtgctagtttccaagcccaggacctaaaagcctggcagttgctacatcctgtagcttagaacacattctttaagacactgagacactaggtcagaagtccaactaccctgagatggccatgctagagagaacacatttaggtgctatagttgatgggtcacacatgagcccaactctccagccatgagtaaagctgaaacccattgagtaatttcagtagatactatgagagcaaaagaatctctcagttgaaccctgcccagattcctgaccccacaaatgcaaaatgtaataaaagagtggttgttataatctgctacatttggggaacacagagcaaagagacacagatggacttaagatagataatgtaagtgacttcaaggatagtgatgccattcattttaataggataaacagcagatggattttgtttagatgagattagaatcattttgtgtgtgtgtgtgtgtgtgtgtgtgtgtgtgtgtgtgtgcgcgcgcgcgcacatcaagtttcagacacgtggccaggcatggtggctcatgcctgtaatcctagcactttgggaggctgaggcgggtggatcacctgaggtcaggagttcgagaccaacctgggaaatataatgagatttcgtctctacaaaaaataaaactaaaaattagccaggcatagttgtgtgtgtctgtagtcttagctacttgggtggctgaagcaggaggattgcattagtccagaagctcaagtctgcagacagctaagaatgtgccactggattcctgcctaggcaacagagcaagactttgtctctaaataataataataaataaatgaatacataaaagagagaggaactggaagaaaatccagagaaaactgaggggaaaagctattagggtcccaggaaagaaagtgaaagaaaggaaagaggccttctttaaaaaggagtgcttaccacctgaacaaatggtgagatttcaagataaataaaacatagatttgagggtgtatcaaatttcactgtctgtattttttgagtcaaacaaatggggaggaaggaaaagacatgataattgaaattttgaaattgaagagtagaaaaattaagggttaatttcatggaagttggctcaatatgaataaacctgaccagaaacctgaaggtccagctgagtttagagtctctcacccactcaatatttactgagtgacaactgcatactcagctctatgcatgtatgaatttgcaaaggaaccaagaagcatgaggtaaggcctattgcatcgataagcagcaaccatggagttgatataaggaagccaagtacagagtcaccaggaccaagaacttcagagcaggcagaaggttgaggtccttaagaatggaaggaattctacaacattcccattgaccaaaacattcaggttgggcagagaaacaggtaatggcactgcaaatcaagacaagggaagagtatagcttctataggaataagagatgctgagcatgaaggtggggatgggctagggaggaaaacagagagccagaggctcatctgtccgccagcccacaatccctgcccaagcacagagcactgtaatggacaatggatgagaaaatgctcattgtccctggattataacattaaaactatgagtttcacttttgaaaaggagttacagtgtgcaaaactggtgtctgctttagaactccagtccaaaggtaacaagatgaagtagcctatcttttctgagcttcctgatctgagacttaagatatgaaatgttatcaaatgatgtatttcaaaataaaatagcacttgttagaggtgctttagatgtgatttcattctgttaaaagcaaggaggtttggggcacccatatcagttcgggtaaattatcacagtcccacatcaaaacagatcagcaatgataaagataaaatgggaaggatgatgaagtggcaatcaatccttaatacatgctagctctgcagtaagcatggtgccaagcactcacacccatgcctggcacccaacagccacccagagccatatcaatgataagtccactgtcacagagcagcaagccatcatggagatgggttggagcactgccctgtcattatctccaagaatgagtgcaaatcaactagggactaagagcacattcttttcttacacatagtttttcaacgtgcacatctaagccaacatagattccccttctgctaccgatgaagggcatcatccagacctgcttgtgaccgcaactgtcctttatttacaatatgccctccactctgatcttaacagacttgatgttagaagccctaacatctttgccacctgaatgaaaggaagagaaaaataacccaagtgtctgaaatgctctttccttgggatttggaaagcgacaattagagaagaggggaaatgacacatatagagaatgagcagctaaaatggaacacgtagttcaagggtgatgagctgaaatgacatgtttgtcatgttaggaaagaacatttaatgagaacaggtaattttttgaggtttataattttcagactacaacatagtaccttttttcttaaactaaaggtactgtaaactgtcattacagtaaggtgacaggaaagggcattcatagtcttcatgcagagacgtgggcttttttaagcaacttaccatggaaggctaactccttgaagaggcttttactctaaatagactcagctctaaatagcaggtccctccttcccggactcagcaggtccatattccactgaatcatggagctcttgcctctcagtggtgtaggaggaacacattcataccagggcttttagtgctcacgctcagcactattgatattttagtcatataatcccgtgttctgggctattctatgaaattagcagcatccccggcctgtacctactagagctagtaacaccccctcccaccaccaactttgcaccaaccaaaattgtctctagacaatgtcaaattgcccctggttgagaacctctgctatagatagatagatagatagatagatagatagatagatagatacatagatagatagatagatagatagatagatagatagatagatagatacatagatagatagatagatagatagatagatagatagatagatatagatagatagatatagatagatagatagatagatagatagatagatagatagacagacagacagacagacagacagacagatgcatacatacatctgcatatgcatacatacatagataacttccctctttggaagttaaacaagctgccatgacttgaaagattattcaaaatatgcttatataaaacaccaaactaaatttgtgttgagtcattcaggcaaaatttcaagatatatgaaattcctgttaattataactatgtgctacatttgggaaatacattatgaaggaattttcaaaggatcaaagttctatcatcattcaaccaactctagaaaaataaaaatatattacgtgagttaatatgaaacaaatgaatttgccaatatgaagatttattctagaaagccaatttgggagacaacatataagcatttttggtgcgtctacttcaaaacccctgaaacccctaaacttccttttattttccagatgtaggaggatatctctataagctcgatctaaataagtacaactctgtatagaagtgtttgtgcaataaataacatttctcattcactcccacgctacaactgaaactgaataggctttggggacagaaaataactgctccttttaggaaaaaaaattgctgtcagataaaaaagaaatcaaaggaataaaagcttccatgaggcattttgcttagggaacagtgtctaaccagttattagtaaaaacagatccaacataagcttaatgtacttttcagaggaggctgggtttcttctgagctataggcctatcataaagatggatatagcctaatctgttggtatagtccagagagtccacaaacccctcctgcgcccatcccctacttgatggcattagagacttgctttggcaaaaggacaaaggagtcaggtgagtgagctgacctagtgaggtggcctcagagatgtctcaggaagtcctgtcccatgcatgccacagcaggacaatccttagtaccaaaaggctgaagcgattgctgcatgtgtgtctcttaattaggaacagttacagattgtcataatgtaaaaaaacaaaacatccaggatttgcaggagaaggagttggaaagcgcttttttttttttttttttttgagacagagtccagtctagttctgttgcccaagctggagtgcaacggcatgatctcggctcactgcaacctctgcctcccgggttcaagcaattctcctgcctcagcctcttgagtagctgggattacaggcacacaccaccacacctggctaatttttgtttttttagtagagacagggtttcaccatgttggtcaggctagtcttgaactcatgacctcgtgatctgcccacctcagcctcccaaagtgctgggattacaggcatgagccatcacgcccagctggaacgtgcttttcaaatgtttgtttttgcatttgttctttccatttcttagccctgttttaagggatcagatgaactgctcacacagaaactagagtcgccttccagactgaatgcagaaatactaaagaatcattccagcaaacaaaccaaccccgaagccatgccctacacaccctgacagagccaaagatggggtccagtgcatgattgtcagctgctgcccagtaaatagttctgcgtattgaaaaactcagtattcagcttctgcctttcaaaaaaaaatcatgcttttagaggaatagctgagaatgagctccttcttaatctgtctccactactcacactgcaagaccttccctgtggtccctctcaccttgccagggtcctcagaggcagccttgcacactcagtagtcacatctgcacccttgctgatgtcatgagcccctcatctgtctagtcctcccactgctcctggtgcagactgtcttccgtggtcacaccatggtggctgacaccagccacagcggcagctcctttccagaaacccagatgggacattagagtgcctgccacaccactgcttccacgtgaaaggttgccttggagagacccagaccttttgtttctaagtcttgattaagttttgcttctctcttttattgtaaacaatctacacatagtcccaatgccaagtgtatgtgctccaacatgctgaattggctgcctgaatgaacctgagaaaacagagctagtgtcctatggaccatttataatccacccatcccctgccactgagtgagcccattgtgaggtggcttaggcccttggtacatctgagacaagaaatgagtcaaggactcccagaatttggaaggtgaacgaggaaagataaatcatctagtctctcttccctctttgtagctgagaaggctatgggctcagagagattaaacagtgcatgtgagatcaaaggtgcagtgacaggccacatcaggatgggtcctgctaccttctggctgcttatattctacagcccaagctctctgctcaggcttctaaaaccacatacttatggccacaaggtcacatgacctgaatcacccccagaccaggagcatagccttgtctctagtgaatataatcagggatgaacctaaggcatgaaaacgggcagtgtcttcggggtatccttaatctgtattaaaccagccataatgaaggatttcttcggtggacaaggtacagctttccaagataggagcgaggatgaagaggacactagccccactactcccagatcacagctcagagtagtcaaacaaagaaaaagctctttttatatttatgaaatcgaagtaggaatagaagcaaagtcgtcagaaacaaagaaggaagaaatcctcctgaatgggggaatatagagactgtcatctttaaagaggttcaagtagagcgttcaatgaaacaggaataaacaatccaggagaatcaaagcccacggtgtgttcaggcctagaaggaatgtattaaatgaatctatgctcttttcttgctgttgtatcagatattctaggtacagtgtaggaaatggaattaaatgaagaatcaataaaacaataaacttaagttaatgcaatgttcaagtaaacagattcttctaatctttttcaaaaacgataactgaacattttattatttgggaaatacagtgaaattaaaggtttcttcttattacattgagcccataaggggaatcaggatgttccacaaatatatcacatctcttcaatttttatagtgcacttttaaagaaacaagatcttttttatattattttaacccacgtgtctcgattgccaagtttcagctgaaagaagtttgtcataaatgaattagggaaacatctttaggaatgtcttactgaaacacagaccactcttaactccagaaacactactcactgccaccttcaggtaactgaagaagttggctttgttacccacagattttcatcatatctgaactcagaggagatggaattttatggctatataaaaggacctcatgatataaaatggaaaaaagcaaacattaaactattttatacatttcaataatggttcggctccagtgaccttcttttatatctcccttcaaagggaattgttattatacttttgtcttcttccccttgtttagctccagatcgcctggaggaacgataaaaataaatgaagtccattagataaaattattatttacacaaaggcaatattaattttatctgtcagcaggttttaaaactaagtgaaagttcattcaatctacttctgtgtcagctaaagcaacaaaagtcctttctaagaaaaaaaaaaaaaagaaaaagaaaaaagtacttaaataatgggctttcaaggcaatgtaactaccttggcaatttctaaagaatttacctagagatgtttcctcagggcagaaaattcatgtggacacactaaaatattccagttataggccgcgcgtggtggctcacgcctgtaatccctgcactttgggaggccgaggtgggcggatcatgaggtcagaagatcaagaccatcctggctaacacagtgaaaccccatctctactaaaaatacaaaaaattagccgggcatggtagcgggcacctgcagtcccagctaccctggaggctgaggcaggagaatggcatgaacctgggaggcggagcttgcagtgagctgagatctcgccactgcactccagcctgggtgacacagcgagactccgtctcaaaaaaaaaaagaaagaaagaaagaaaaaaaagaagggagcaccattttctctttcgtccactgcaagatgtggagtctatgccaacacagaaaagcaatgctaccacagtgggaagaaaagacgatacccttctactgtcatcagtctggtcaacatcactgattacttcctgcttgtgaaatccaggaagcttatgtaactagatatctccatggcctttgtgaccactgacctttccttgaatatctcctgacatcctgtcttccctggattctgtaactccccaatctctctgtatttatttcacatctggcattctcctcgaatgaaagtacactccaacctcttctgaatgttcattgttttctccatctacacgttctcagaggcccttttcttcaaacccatgtgatttcacatggtctctaaaaactggtgactctcaaatctagatcctctccccaacctctgtatataatctagactcatacatcaaaataggggtatttacatataaaagccagtgtaactgctctaaagcaggcctcattatctgtcttcatcagctgtctcccttgcgtctgcttcctctcatagctaactacaccatcactcagacagccaactcagagctcaagggatacccaccattccctcctcctccatcttaccaaaactcactcctcattttgtgagtgtcttgacaatccttcccttacccacatttagaacccatgccctcctctggaatccatgccctcctctctgtcctgaccaacctcctgtatttcttacctctgcaatttcagccatttttgttgttgttgttgagtttccttgctgctaatcccaacccttaagcatcacttctatggagccttctatgaattttttcccacttttctctcgtccctatctggccccactgtacgttgattcttattcctgttacagcctttatcatcctgaactacaattacctgtgtatctgcctccttctaaaacaaggctgttaaaaactcagtctccagatagtactggacatagtgcagaaaaacaatcaacacctgagaagtggattgatggagaaaaagaatgcaaatccacatgtgcctctctaccttacctctgtacctctttacaatattagcacttccattaaaatgccatccaagttcccttttcttctatgactctgccattcgttgtcacagatgttttatccctcttttaaaattctcttaacatctggtccaaatataaagattcccatggttttgaaaaatgtcctttctaaatgtcataattgtccaattaatggtcaaagggatgaagggattactatagccagacagacttaaaaaaaggggggtcccctgggcctggaaacatgaaagcagacggaagatatcaccaaatgtatgaaccctgagggggtcagataagttattccagcacagataattcactggaaccacttgaaatgtcaaaggacaaaaaaggaggatattataattcacaccagaaagaaacttactgaattaataattttaggttaagaaatacaaataccttaaaatattatcagataaatttacagtaaatagactgctaataaacttagataaactatttagcagaaaggcttctgatctgatgttttcagattttagtcaggaataacacggtgtatatctgatgaaaccttttaaatccaatggattagacatgtcaatgccgatacctttgagttaattagagtttgtcacaatctttgatctcaaaaaaaaaaagtcagacctctagagcactaatcaccatttttggtgagtatattaaaaataaaaataagaaatccatcctaaaagaaaaaattaccaagacatatcatataaaaatcaaagatttcactaactagacaataaaaaagatgcaaaaaatccaaagtaggttatgtacactactcaaacatcttttacaggtttcctgaaatagacctataagataagtgttctcattcctttgccattttgcagatgtggagacaggactcaaggaggtcccatttccaaatggaagaagtaaaattttaacaggtaagtccctggccctaaaacccagggtcatcttgctgtcctctcacttctacaaagattgtctattgactaaggattaggagtcatgctagacacacaggtcatccagctgaagaaataagctgatgatttattcctactaactaacttcttgtcgggcctgaaaatgtgttttcttagagaggaaaatttcactaagtaactagctgcagcatcattcactgaccctgggaccagagacctcactgaccaggatttaatccagcaaatgacgcaatggctttgtccgtgtcatgtgccctcctgtccttgaggcaggggcagaggggcaggatgggctcattcagtcccatgacttaaataacatttatcggctggtgaatataagtgtacatatcaccttcaacctgtgcctgaaactgcaacttcatctgcctcttcatctctacctgagacaaagaattgcctcccaactaaccaggatcaagcaaaccactggtggtcccccttccccagtctacttcctggctgagtcttcgccatcacagctggagtcattttggattgctctaattcccccacacaacactctaaaccataagcaaatcccgtcactacttcctcaaaaaatgtataccgcacccctgtccccttctctcccatctgctactgcaatcccacctcaagcaccttcctctctcacctggatttagcagaagctattctaatgtgccttggtgtttttcattcatgcccctcaaaagtccattttctgtgttgcatccagataaatctttgtaaagagctcatctgattaagtaatttttccctgttcaaaaatttccaatagatctctttgcaacctccctaaaatgcaagatcctgaccccaccaacaaaccctcctccatggccacctccctatttctacatgatctccagccttcctgttccctgtgctcccgccacacacatgcacacacacatatgcacatgcacgcgtgtgcatggaactgctttctggtcttgaaacccaccaagctcatcaccttgcagatggcgcttgctggcccttagatcctagatctttttctacattctcccaaggtcccttctcactattcaggttttactaaaatgtcacctctacaggaaagcctccctggccaggcaggctaaagtacctcccttttactccactattagattccattattattttatcttcttcacatcacttaaaactacttaaaattgcttgactgatacatttttgagtttgggaatttttttacatcctattatatgaaattgatttaaaggatctataattttcacagcttctccttttaatgtgctgtatgtatatcaaaataacatgttgtacatcttaggtatatacaagtaaatacataaataaataaaaatatttcataagatacaggtatattcagtaccttcaaagaaggtaaattgagggggggaagcttcagtaatgggacagaataaaatatattggcgagctcaatgacagcaaaatagtttccagaggcctttgtcctcagtcatttcagtgatattggatatgtatgcttgtgtgggaggaataacaggacttagattatgatagtcagttgatgtccttgtgtgagtcctgtttaacacactggaatacaagtaactggaggacagattttattttgttctcttgctatccccagggcctaggacacagtatgacccatataaatattatcaactgattgactaggcagtggaaaggccagaaaccaagatagtcattttccaagtgatggataaactcactatgaaggccaagataccttctactaaataaaggcaatgaatcatccactttattttagccattgagcagtgcttacggcaagtttcaggagcactgctatggaaaagtacaagttagttcacagtcagcctattaggtgaaacttaggaatacaaagtcagtacagaattagcttcccctaaagcatctaatgattagcacatatgcgatgctataaaatctcacatgctgtgaacatacggtatctcatccttcagttcattagcctgaaatgtggagaggtcatggaggacattacaataaaggtctccatggtggaaaagtaacccccaagtgtgttcacttctgtatttcaaaatattaaaacctatgtgatgggaaatatgttaatgaaaatacaaaaatgatcccatcctaaatataaagccagaaaagtgaatgacagattgcatccatttggtaagtagctcctaaatactgaaggggttaaatactgttgctggatgcctgactgtctcctttttcagtccaaaagagtgagaaccatctacggtgttcctcagcctacaaagtaccagtgatccaccctgcctccaatgctagtttaggagaggcagccttgcatagatactaggagcacagactctggatccagatcacctgggttcaaatcttcgctccaccattaaccttatgcttcagttcccatgccctgtaatatggagataaaaaccatagcttaaaattatatgagttaatttgaaagaacttagaccacttactggcaattacgaagcactaaaaaattttgacaattataaacaaataaaggctatttaataaaaagaaaaatgctttataaatcttgtaggaaagacacgtctaacaaacaaattagtgtcttcctaaaaaaagacaataaaaccagttcagtgtttaataagaacagtgagaatgtgctgccttagccttaggaaaattcaacatctgcccaagaaatctataaaagaatgctcatagcagcattgttcataatagcaaaaaattagaaataatacaggtgtccattgagagaatgcaaatattcatggtctcttatatcacagtgaaaatggatggacaacagctatatgcaaagtaaatattagaaataagaacgttgagagaaaaaagaataatatagtaaatcaatatttaccgccaataaaaaaacaagcacaattaaacaatattttgaattcgataaaagtaaatgtgcaaggaaaagtaaaaggaagcttcacagtagtgctactgtgaatatgaataagtgtggtatgaacaacagaggtattccccaggatcaagcccccagtggaatgaggtcacccacagtccttcttaggccccacactttcccacttccacccttctgcctggaacacactcccccatgtccattttagaaccttatccattctctgaggtccaaatcaaacaccagctcccccaagagtggtaaccatttaccatgtgagaagcaaggaagcctccaggaagcgtgctcaggacacaccattgcctccatggccctcagcacgccctgccgtggagtctggcttcctgtgatgtgggatacggtgtccctgctgtacactaaagccacaagaccagagcctggcctgcttgttactgtggccactcactgcccaccaaagtttcttgcacgtagaaagtacctaatatttatggaatgaacataacaaccaaccgagcaataacaagtcatggaaagaagccccaggttgatctgggaggaggtgggggagcaggcaggttttggaagtgtgggaatcatgtcaacgaagtggaaataaagagaccacacttttggcagagaaatgaaataaagtctcaagatagaatgtaccaagaatggaggtagcaaatgcatttttgtttgaaaagaccaaagttataagtagtatggcacatccatactattaaatattatacagcttattaagccaatgtagtaaaactctatatactgagtttataaattcaataatgatgtgagtggaaaaaaataaagtgcagacatttatttatctatagattaaaaatagagaagaaaaactccaatgtttgactaaaataaactaatttttttaatgtttgtaagtgccaagaaaattgtggttactcctaagtcgtaggaaaatttttaaaaatataattctatattaaattttcaacaatatgcatttattaatttggtaatttaaaatgagcaaaatatttacatttaaaggaaggaggtaagattagttttatgggttaaccagtgagacaggacttcaatgcacatatttagatccagttcagggttgacttgccaggtataagacagcagaaaaccatggagggaaccattgctgcagtacggaaaagaaaaaactggttcaaagaatgggaggtgtgaagatataaaccttcataaagcagaggtcttctttccataagtgttctccaaactgaacgtgaaatctttgttattctcatgtaaagttgggccaaaaaaaagttatgttcagaatgtgtggcgtacaggtgtagcctgtaagtcaatgatagccattcctaaaactggaacctgctacctcttacttgctagactcagtttacctggagggaaaaaagtcacttgtacctaaggaaatgaaattggttttatcagctgcatcagataaactatgttatccaaagctttctgcttataccaagaagaaatgctcaggcacatagtcattgacactttccactgtgacttggccatactgcattttggtcctcaaagtggcccccgtagctaggtaaatagaacacacctgttaattcgttataggcaaagtagcacacatgtttttctctgtatgcaatagattacatttctggttgagtgagtagatgaaagtgatgtgccttctctaacatcatatgtaggaggaaaaatgttctgcttaatcttactgttcaagaaaatccctgcagttctctttgattatgaccacagtaacataagagacagttcattaaccacagagatgaaactggaggagatggggctgtgctttaaggaataaacacttcattctggaaggtcagatgtttcccaagcacaaatctcacagtttaaggatacttccttgcaggggcacacagacagatctatttagtttagtaactaataccgtgtatcacaataaatgacaggttgtggaaggaagctacccacacgagaagtctggaaaaaagttagtttacaacttgtaggatcaggcagtactttaatgactgtgagttttaaaacacaaacatgaggcagttggttggtatggctgcttaacagaacggtctcttttgatttaatgcgcgtgcgtgcacacacacacacacacacacacacacacacaaatacatcctaagagcttaacattatttatctactttgcctagttggtttcacctctaggacattctccaaaggaattcatcagatattttgtgctgggtatattttcttgatttctgtattcttgatcctctggcatttggagccttgtttctagagagactggccctcctagggctagcatattcgtaaagacagcaaacaacaccccagaggatacctctgcatacctaccaaccagccaagccagagcccccactctcaaccatctcctttatcaaattctcacccaatgtgctaatgttccccctacctaaagcaccccagagccaactaccacagcagtagggaacaccacatagcccagcacccaccaaaaatactcaaactctcaaatcctaaacttagtgtactcaccctgccttgcccactccttacagagagaaccccagtcaagcctctgcaagcctcggttttcttctgcctcccaaccctccctggtccttccccacgtggccctgtgtagcattatgagcctcctgtttacagagtctgtgagcataaaccttttcttcatgaccatcatgtctgcctctgctgtctcaccatccttgattaacacaaatcccacagacatttttaacatagatgtcagcaaagatttacactgaaatatattcaacctagtctgattattatgtgttacaagcatcgtttggaagcttctactgaggaagagggaaatagttctatacaaatggaacaaggaagacaaaaaaaaaaaataggaccaaagaagacaaaataaaatcaggaagacaagacattgcttttaagataaatatgctcaagttataatattaagtgtattggcaagaaactcaactctatgtacagcacataaacaaacacacacatagttgcacacccacatatacacatccacacagctgcacacataaatgagtgctcatgtgaatgcacacacaaaaacactttcatattgaaatataaacatacatttctataatttataaaaccagctgcacctatcagtgccaggttgcaaattccagctcagccacttcctggttgtgtgttctgtgcttccatcttcaagtggggataatactagcacctttctcatatggtttgtaaggatttaataatttaatcaacgtaaaacacttagaacagtgccaggtccactgcaagtactcaataatggttagacatgacaatgcaggtctttaaggttataatgaacatctggagaaaaacacacccaatcattagaacattctgagatatatggctttgcacatttttaatgctttggggcaattgtttttgcaagattaatgtaaattagcatgtatgattattataataaaaagtcatgtatccttttgctaagaagatgctgcagacaagaatcaagatgaattgggagcttaagcgctgtctctaattcacaccaccagaggattgcagtagctttactaataagtccagtccccataaatttgttatacatggtcatgcttgaagatggcatcaagaatgtggaagacagtgtcaaagacagcccttaattatttttaaaatgactagaattctcataccaaattctcaaatcaccatccaaacagcctcatcctaactccacaacaccatgttgatcacgattccctggagcttggcatgtgagtggtgctcttctgataggaagagctgatccacgctatcatcttcagagaaaaataaaatagagtgcaatgatatgcccaacttctctacaggaaatccaacatggccaagtattttttttccacagtagaaaacttgaatttaaattagattttttacataagcagcacaatgaccaaagaccactgactgagatgaaaacagaaaaacacacgtcaaggaaaacactatgatatccagaagcctagaaaaaatatgacactggtgtggcatcaaattccagatcaaattaagtgcactggtggcaagcatccataacttcctaaatggaagtcggagctaaagtgttcaaaaacaccagagctggcatcttcatttatcttgagagtttcccccacatatcgtactgaagataaaatacaatgagatcataacccttcaaaagcgtagcttattgtgcaatatttttctccagtggttaatggtgattctcacagattggaacagaaaaggttatagcaagggccaggtctgcaaacacattgagaaaataatttcctaacagacaagagcctcagtagagtagaaaagacaccagcatggctgaggatactgaagaactgcaattcaggtagatcaggtaccaagcccttctgcccttcagatgaaaagtctcttccatttaccaaatttgcccacaaaaatatttcaattttctgtgtctaatgtcatgaaaaactttggaaaaaactatgagagtttgagaaacacaggcctaggtttaatctggaaaataaagtatgattcggcaaagtgaaccttctagcaccaggttatcagcaatctagaaagtggctgtgccaggacttgaattcacatgtgtctgaatcggaaaccactgtgcaagcctgtgctaccaatggtataaagactgactgttttgagtatcctgataatttgcaaaaatattgtaccatcatcatcaaagaaaacgccacattttttaactttgaaaaatgtgtgcttcatttcaaatgtaagatagtgctaagatagttacctctctataaaaaatgaatttcaataacccagcaatcccactcctatgtctatatctaagagaaagaaaatatctgttcacataaaacttgtacatgaacattcatagcagcactattgataatagtctaaaaagtagaaatgatctgaatgtccatcaactaatacatggagaacagatgaagaaaatgtggtagatgctacaatgaagtgttattcagccagtaaaaggaataaagtgctgacatatgctataatgtggatgctataacatgctataagccttgaaaacatgataagtgaaagaaatcaggcacaataggccacacattttacgattccatgtatataaaatatctagaatatgcaaatccgtagagacagaatatagattagtgattgccaggggttgatggaaggaagaatggagagtttctgctaatggatacgggtgttctttctggggtcatcagaatgttctaaatttagataacagtggtggttacacagctctgtgaatgtatgaaaaattatgaaaaatctcaaaagggtaaattttatgatatgtgatttatatcttatgtaaagctgttattaaaaaataatttccaactagcaaccaggctaccaggttcttgtgatgatggttccagcagaagctggtgatagagaaagaagattagggtgtggctgatgacggaaaggggccttgaggggaacttctcagtcttgggtaagaggggcttccacagtggtgtttggtgatagcggtgactatgggagtcacaaaagtaaaggagagagctctttatataggaagctttccatagtctaggttcccattagcttgacatagatggtgaagggggataagatactggtatacatacaaagtaaaagagccatatacaccgtggaatactatgcagccataaaaaaggatgacttcatatcctttgcaggaacatctatgaagctgtgaaccatcattctcagcaaactaacacaggaacagaaaaccaaacaccacatgttctcactcataagtgggagttgaacaatgagaacacatggacacagcgaggggaacatcacacaccagggcctgtcgcagggttggaggcgaagtgagggagagcattaagacaaatacctaatgcatgtagggcttaaaacctagatgatgggttgataggtgcagcaaaccaccacagcatatgtatacctatgtaacaagcctgcacgttctgcacatgtatcccagaacttaaagtaaaatttaaaaaataaaagaattaaactcagataacttaaaaaataaaaattaaaaataaattctttttatcattttcaattcagaataatttgatcaatttagacaaattaaacaatctgaagatctaaaaaaaaatgtaaaattgacattcttcttcaatagtttgaacacaatgtacatttttttttttttttttttttttgagacggagtctcgctctgtcgcccaggctggagtgcagtggcgggatctcggctcactgcaagctccgcctcccgggttcacgccattctcccgcctcagcctcccaagtagctgggactacaggcgcccgccactacgcccggctaattttttgtatttttagtagagacggggtttcaccattttagccgggatggtctcgatctcctgacctcgtgatccgcccgcctcggcctcccaaaacattttttactgaaatgcaccagctctccagatagctcattgccctgttaatattcatgaagaaatcaactctacaattactttaaatacgttacattatatacaattataatttattataatttacattacctagaattataaattacttcatgatttatatgacttatttccatgatttatttaatgcttgtgttggtggagaccagtgtctgacctcaggaactcactctcctctccaaaatgcatgcttttgtgtacccttagacaaccctgagagactaggtacacatttcttcactccaacttgtttattaaaaatttccattcttttcccagaattttttttccactgttcaagcaattaaggcaaatagctaaagaaaactttttcagtactggtcattcccaaagagaagagcaagctggaagacccagtgagcatgaaggtggatgagcagtatccataaaagtcgcgccacactgcctggacctatttcttccactatgtatcacaagtgcttgcatattttactgtacagtgtgttaagtttcagtgaagacaaagggtctagtgccatatgtcagccaaagacaatgtttcccatggtgtccacccttaattattaaacatgtccttctagaatctcagaactatcccaaaggccatatgtgccacctcgtaatgtgaggcctcaatcttatgacacctgtgcaattacaatgactcagcatccccgtgtggtcctcttctcagctcctaaaagaatcaccctcattccaccattgccaaagcacaggaatataatgtgggacgtgctgtcaaaacaggatttcagatcacaaaatagttatgttccccaaaatcacagttctataaatcgttagcaagcatctttccataaattaatgccttgaccactaggcaagactctcatcctatggggattttctgggcaatgtttttgtcctataggagttttccttaaaaaatttaaagatgagaatcagcctggggttgctagttaagctcaacacagtcctaataagcagctgcttctgctcccaactgtcaccattccctccatatcaatatctctgagaaggtcagcacactgtcttcagcatgctctaataaatcaaacacaagtttgtaccagtcgaataaggccccgtgtatgtgttgctacacacttgtctccactggtctacaacatagaaaattgtgtccttatttgctgtaaccacatgttcactacaattaactctatacatgtacacactacatgctggactcagatgtctaaaccatacttctttggcccatctatctctcttaatgtcaatctataaaggaggatccacagaacattcatgtaattactacaattaacaaggagatgcaagtcacggccagggactagtaagttctgctataaacacacaatcacagagcaataaaggattttggcagcttatctgctctttcatcacctctctggctcttgcaaaagtggagtgtctcaacctcaccaccaatttcacaagagatgctatgactttatctatgattcctccatgcaaatgtgactattctataggccctttgagctctttctggaatcacacagatgtgagtttgaaatatgccccactttccagctttgtgactttgaaagagttactaatcttcggtaattctcttttttcttcttctaagaagtaccatctacctgtcaaggttttggggttttgagtgttagtgaggtgaaatgatctactggtaccatctacctgtcaaggttttggggttttgaatgttagtgaggtgaaatgatctactggtaccatctactcatcaaggttttggggttttgaatgttagtgaggtgaaataatctactggtaccgtctacttgtcaagggtttgaagacccaataatctcatcctgcttttaatgttcccaatacaccatcagaactgtattaagggtccacaagatgttatctgttgaatgcccttctcaccttgccccagccagtatcctggttgaatcattcctggctctgttctcctttttctctcatgtatcctcaacatggcttaaacccatctatcaggaacttctggacttggtcttatgacagcccctgaacatggccagcaagatgcaacacaaactcactccaaattcctcttcctgcctcatggtcctctttgcaccaacaattcagcacccttgacaccagcattttcatgcctacatgccccttgctctttatgctccaaatgccatctccaaactacaattttctatcttctcccattttatgaagatccactacaaatgcatccacaaaagctgtgttaattaccctctgtcatggcccattcgaatgaattattccttccaatttgcattcaaactcattgtatataccccttattatttcacttacaaagtgatataactgtttatgaatttaactccccaatacaaaccagaccgtaagcaaagacactcttttagtacagtacacatttttatcacaatcgagcttaggtctgaaacattgcagagacacaggcaatgtttgtaagacaaatgaggaagcacaaggaaagattaggaagcccagctcctccactaggcacccgagtttaagtctctgtactgccccttgctggctgggtgactttgggcgagttatttcacctcactaacattcagctgctcgttacaacactagcatattaattgtactttccttgtgggttgctataaggattgtaatattgaataccctccatgcatcatctcacactgactagcatacaatgattaacacatacctgctgccacattataatgaaaattggaacccccaattttaagccatctcatgctctgctgaaaaatgagccaatcctctttgctgaatgctccttgacagtccacagaggcttaaggcttagaagcaaagaacttattaaaataggagggaacgagagaaaagggaaacagtaactgttcacagacagctctcctcttctgccactacagccagtcagaaacatggcaaaggtctggatatagagtgtttacatccaagttctaagcctcacccagcctcctactgtgaatcagtttgtttgtttgtttgtctgtttgtttgttttttgagatgaagtctcgctctgttgcccaggctggagtacagtggcatgatcttggctcactgcaaactctgcctccccagttcaagcaattctcccgcctcagtctccccagtagcggggattacagatgcatgccaccatgccaggctaattttgtatttttagtagagatgcggtttcaccatgttggctaggctggtcttgaactcctgacctcaggtgatctgcctacctcagcctctcaaagtgctgggattacaggcgtgagccaccatgcctggcctgtgaataggttttaaaagaattacatatgatttctctgttcattttcccacctatgaaatctacagctgtcatatttcccagaaccatggtgatacgcgttttcattagctgcctgccatgaagttagattaagaagacatcaatgattttttctaatcaaagtcataaagtcaagtggtttcaaataacaacctccactatatatatgttaaagagaaaaatagcacccatatcgcagcctgggtgcccataatcttctaataccagtaataaatctttctgcgaaggctaaatcatttataaacttgttaacacagctcaagtctctaatgctgtatcactaggtttcttacttaatcaaattgtttaaaaatgtgtatttgcaatactgagtgattaggaggtttatcttatgaaagaccattccagtgtcccgttgtacacaaataatttgaaggcaatttccccttgttaagggtaaaaactctgattagactaacttctgatagctagttattgagatcacagaaagaatgcagccactagtgaataaacaaatactaagaccttccaggtggactgtctcaggtgacctccaaaggttaattcatgtaaaaaggatactgccattacaaccagaaaccaacaagttatgccctccttttgaaaagtattagattccaggatggattatccagccaaccaaagaaagggcgaatataaggtaaccagctctccagagtatgttctctcacccagtttaatgggaagctatgtggtttggaagcaaattctagagttacagaatgttaagcaagatattcattattttaccccatcatgaaacaacaagcccaaacagctaactccaggaacgttttctgagaccgtgtgcacatcaagaaacaagaaacaaaataggttgttgaaaacacccacatgttacagcatttctgcccttcctgaggatgggaataacattagaaataacttcacagaaaaacagactccccagagattcaaaattccccaggaatctcaccatttggacagacatatgtactctggaaaaattgttcctatcatccagtagccatgaattctaacttagtctaaactttccattcaaaaggcagcacctttcttaattttaagcaatgtctaaagtccaaagccccaggacaacatttcttctgagcctgtgtcagcttcattcagtctcattgaactgaatgatgtataatcaaagccaatgggattctgaaggagagagaaagtgagaatactagactcaaacctgaacagagctgagtcaattacagaaaagtcttggcaaagtaacttcagccccatgaggtgctgtttctctgtgggtaaataaggatactcacagccccctgtctcttggggcatttgcaaggagtgaatgagctaatacgtacaaaaggtggccagaatgctgggtgcacagctaatggccaataatcatgaattaatctccatgcccttttaaatggagggacttcgaatatgctggattctcttccatatcacttattactccatcattgaattggccatatagaaggcatatgcaggtaaacgatgtctgtaacagaggtcaccaactcatccacggtgagcagatgcagacaggtgcatcatataaggtcacaagtggccagcaaagaaaaggactcacaggccagcagaaacaacaagatgatgaatatctgggacctgtctttacccaacaggaataaaagaaacttgggtttccaatttaccatgaatgatgatggtactacaggtcttctgccttacgtagtcagagaagtagacatggaggaagaatttgttagaagcaaaataaagcgaacatggttaaaatgacaacaacaaactagctctgtctcagaggactccgcatgcacaagagcagtatttgtccaaacacaaacattttcccagtggcaatgacttacttactgctaagtccagcagaggcagcgatactaatttataatgtgtgaaataaagaaaagataacacaggcttctaaaaggctggccagtgggaatagtcacataaagatcccagcctagatttattaaaaattacaataattagtcctagaaaagtagaaaactagaattattttctcaaacataaaacaaactgccctcatgtcagtactcaattccagtgagaattgaataaatttctgctttgggaaaaaaccagcaacactgattttatctttaataaaaggagttataaatatcaagaaaatattttgatttgtataaatgcatcaaatataaaatttaagccttaaatatttattggatatgtcaagtatggatggcactggacattttaaaaattattcaaagaaattttaacaggtattaagtaactcaaatccaaattagaaaagaagaaacatatataggttaatgtataataactgataaaatatcagatttaaaatcataaaacatctgtaagtttaacacaaatgtgaaatgtttacgtgaagagaatgtacggaaatgatattaaatgaaattagcccaatgcaagtaggtgtcctgtagtagatagatttcaaacaggtctttcagtaaaagttagacagttattaccatggaatttggaaaatggaaaattaagagattctagaatgaggaaggtactgtatcaaatttctcagagaataaacactattccagagttccttagcttcagcgtgactgtcattttggacaggatacatgtttattgtggatctgtcctgtgcattgaaggatgcttagcggtattgcctgctgcttttcatgagatgtctgtagcacaagaaacagtcttgacaatcttagtgatgtttctaaatattgacaaatgtccccttgcagaggaggagaaggcagaattgctctcccttccattgaggaccactgctgtatacaaagatacaatctacaaaaagagtatgtaacaagtagactaaacataaagagagaatatcgtgattttattttccatattttgattttcttctctacttactgtgctaatacgatcttacagaaagtgctacgcatagtaatcaaaactgtatcctgaattagtacaacacaatttcagcacaatgaaacatgggtttcaaaaatcagttatataatggataccagaaaaacaggcttctgttaccacagtaataaggacagcacagtttggtaaatgaagtgaacattgaaatttagccctcatttaacacatttctaaaacttaagcaggaaccacaaacctccaagggaagtgtattttggtcccataagctacctggctgcatttgctttgctttgctaatgacaacagaattaccagccaagtgttcacctgtggaagaggggctataccttcacagggatcagcaataaagaataaaatcttcctcagtccccagctaccctccccatctcttaccctcatgctgctaggtcaactaagccattccttatcagttgatgcagtggcctgccagattcctttaagctctggatggtgagtacctagcgcaaaagtcactttaggaaaaagaagagtctgtagtcctgccttaccaccatcaccatcaccatcatcaccatctctaccaccatcaccaccaataccactaccatgaccaccatcatcattgtcaacaccaccactatgacttttaccactattgccaccatcactactactgccatcatcaccatcactaccaacaccacaactaccaccatcattaccatcactatgaccatcaccactaccaccacaccacaccacaatcactaccacaatcatcaccaacactaccatcaccaccaccattttcaccaccatcttcaacatcattatcaccaccaccaccaccacaatcaccaacaccactgttaccaccaccaccatcaccaccaccaccactacagctagctagaagtctcactctccacagcacggaatactataaccctgcattgggctccagcacaatcaaacttctccttgaacataatccactaaggcactccagctcacacttcttaactccactagacttttctacttcctgcacttttacaattccagaactttctgaagtcattatcttgatctgggatgtcctctccacacaaattcttaggttaccaacttattaagtcaaacttgaagcacagtggatatgcagtaaatactgaattgctcacaaattacagaaattccctccatgatatgaaacaagctttccagtggattggcatctattgatttaactcctacatcgtgcttagtaggtgcaggcatggtactaagtattttatattatcagttgatttatcctcataacagcacaacacaacggttactattattatcctcatttttcatatgaagaaactgaggcaaagggacatcaagaaaggtgcacaagttcacagaactaaaatttgaatccaggcagcagtctcaccatgatctctgaaccactccaatgtgtagctactctacactgaaaacaatttcaaaacaaatttttagttattttttttttaaatgtcatagagtctaagagatagccagagatttttctaacaacagaatcctatttttaagagcctcaagcccagcctccctctcctctgagagcacgttgaagaaaatttgggcccattttaaacacagtttagacatcactgtttttacggcaaatatttgtttttcacagacatggaaactaagacctgagaaagggtagtcgtttacccaagtaacactgaattagttggcagcagagttgaaactaaaaccctggagtcccgatgccaactggatgattttcaattatcccttggccccctggctaatcattaaatagattttctacagaaaggtgcagtttcatatctaccaggtaagaaacatggttgatgacacatgaaaatgattcactagaaaagacaaaagataatcattcacccaaacacgcctcttgctaaatcttcagagtctaatatcgcacagtgcaatttgggattcaggctttacctctcatctaaggagtccaaagcccttctcaggcaaccctgggccactaagttactggccagttagcaacagagaaaccatgtaacaaaaattgtactcatctggtaggctgagttcatggccaagccagaaccaaaactccacctctctctgtacatccacctgtgatctggtgcatgcccccagccctgggctccccctcccgacccacacctgtgaggggacctttacctgcgtgtgctggaggctcctcagctgtttctccttctctgtaactgatttactggctgaccttcagaccatcttaagcctttccatgactaagtttctcctgtgcaaaattacacttctctctctgaggaggtgttgagaatgattaaatgaacctggccacagagcgagagctcgtcagacacgaggcattagatcggggggctgtgttgtccgcggggtgctttctggtgatcattcatgcagatacccaaatcaaagtctccaggtaaagaaaacgactttggaaaactctgtggttttaacaaacacataacaatgcccccacccccaccgttctctggtttcatattaagtaaatcttttactgagggttttttctatccaggcacaatggaaccctgataaaaaattttatgtatcttctatgaaaatacctataaaaataatttgatgggaaaaaatctcttttagcttctgttttaccatgagaatttctttttttagagacaattaaaagttaacacaaaagttttatttctcagtacctgtaatttgtttttattaaattaaagaaagagtatacataacagataagcattcacctatacctataataactgggaaaaaaatcatatgatcatgtaggtctattaagaaagtaaaaattaaatataacaatgcactccagaaatggatactaagatcttatttaaaatacagtatgtatgactaataaattgtcattctcattaccatgctccaaatagttatttcctttcttaattcaccttttgaaagcattttgttccattttcctggggctgttttactgcgtgacttccctgggcattcaacagtcaatctccgcaggattgggattttcatttcacgtgtctttaatctagcaaagcattcaggctactcttttcacagatataaataagtaaatacaacaatcttcaggtaaagaaaaaatacattcctcagggacaaggataaagctggaagccatcttcctcagcaaacaaacacaggaacagaaaaccaaacactgcatgttctcacttataagtggtagttgaacattgagaacacgtggacacagagaggcgagcatcacacacctgggccttttaggaggtgggggtgaggggaggaatcttagagagcgggtcaataggtgcagcaaaacaccatggcccacgtatatctgtgcaacaaacctgcacattctgaatatgtaccccactttttttagaagaaatgaaaaacaaaaaaaaattttaaagaataaaagcaggaaaaaaaaaaaagacattcaagccgcctacatttccataacagagcgttctctatctacttactatatttattcttgagttatagcaaatgacaatttccatctggacttttttttttttttaaataaaggcatttctcatttcatcttgtgataatttgaaaaactatgtatactgtgtaacctaaataaaatagattatagcaccactccaaaaattgctgtcaacttccacacatactaagctagtggacctaccccaggcaaaagaaacagggtcagatgctgcctaatagaaatcaagtgacacgtctttagcatgttctttgctatgccactggttatctgtagaggctccagagtttagtaagtcttcttaattggacatcatttagctcagccactgggctcaagtagacaaataggaagtgagttttccatgtgtactctgttccttatctgcacagtgggtgccctctgaactgagcctcatcagaggctatgtgtctcagcccacacgcaagcaacgtgcatgctgcctgaagtggaagcaaaagtgtgttgttagttgcgcacccatagaagcacacctgagcctccctatacagtgcccaactagaagaggctgagcacttccctcctgtcatttgtagactgatagtccagtcccatcattaccaggtctcacccactgccagaaggatggctcgtcctcagtcccatgaactcagctgtgctcatgagttaccaatgaggaagggatgaaaggagaaaataaaaattaatcttggccgggcgcggtggctcacgcctgtaatcccagcactttgggaggccgaggcgggtggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaattaatcttgtatccacaaaacataaaaactcacattaagtatcccatcatgattataaaatatcaccactcatcacctataggaggataaactaaggctagttaagggtaaatgatattgtgactgtcaggactagggcatttgtttagaatgacatagaaggtcttagctaaatccatgcaaagtgttccccgaaatgaacgttcagtctcctccaggaaggtgattccccgtctcagtaaaacataggtagaaaaatcagtcttatcatgggttacagaataccctttcctttctacctcccccttctgcttgtcctaattaagtcctcgaaaattaattgtataaaaacaaaatgtagtctaccacttattagattatcctatacccaatagactatgcatgaagatctttggaatgatttccttgattgacctacaatattctttaaactctcagatcaggactgtatataaagtaaattataaactgttttattgttattcctctactacttcattgctttttttttttttttttcacatggaacagtcccccttgttattacaggctaagaatctcttatctgaaatgcttggggccagaacggattcagattttgcattttttttttttttttttggattttgggatattggcatatacataacaagttatcgtggggatagaacccaagtctaatcttgaaatctctttatgtttaaatacaccttatacgcatagcctgaaggtgatttatacaatatgtttaataattttatgcatgaaacaatgttttgacagcattttgactacaatccatcaaatgagatcaggtgtagaattttccacctgtggtatcatcttggcactcgaaaatgttttagattttggatcactttggactttagttttttagattagagatgctcatcctgcattttcttgtataaagatacttcattaccatggcaaagcattcctgtaccatccattaacaatctctggtgtttcgttcataatgtgtaccattccatatttcccatccagtgaaatgtatgcataacaagtattggcaggagacaaaacaaaatccttactcctagctatgggtacaaagtcaggtggccaggcattgggctcctagcagtcaagagtgaaggagacattggggaaggtgggcaggtcctcaggaaaactggaaataaaattatccagtgacaggacagtggccaaaaacatttctcaaattgtcatgggaatggtttacaggagaatgggcgttacttaaacacaggccacttatgacagcaaacgtaaccatctacactagatatatatggcattaatcagaaataaagatgttagaaggagaagaatcagaaataacacacctggattctgagcctttggaaagattttgaaagtttaggcaaagagcatccaaggcttcaatggcatgtacagagtattgagcaagatggagctaggagtcacataaacgggctgttatacactggcatattgggcaaagccttctggtatattccagcaagacttcataacgaaagaccttacgccttaaaatagtattaattgaaaagaatgataaggcctgctgggggctaaaagggcgtagaagaagacagatttagaagagagggtaagaatgaatgcttgaaatcattgcataaattaataagtttctgtgtatgtttaccctgttgagtatccacagttacaggatagggaagacaagtggtagcagatattatgtgacaatgtttttgttatacatagacaacaaaagctccatatgctcaacaaaagtcagattacagagccataataatgtacatgtttctgaaacattcctgtattttgagtttccctcaaagcctagcatttataaagtttatcgctggtcctttcaatgaatttcactgaacacaagccaggcatgtatcaaaataggtatataaaatctctataaagtaaataaaactcatcagagaagctggaacagaacatttcctaactttttttcaatctgggaggatctgattcataattatcatctactgtctttcttgactaacaagtgagagccaaaaggatacccaacccttttgtcttggtgaaatgaaaatctattatgtaattattttacaaataacacatataacatgtataaacagacgttattataatcatcatatttcattttaatatttgaggctttaaaggataccattaaacaacattaatttcatttacaataaatgaagcataagacatggaaaactacttggctgcatttaagatctagcgattcaactataaggaaaaattactttcatcgaagatgacagttttcctctagctcttcctactgatgcctatgcaatacagtctcactaaatgagcataaaataaaaagatgtccatttgatctttggacaaagatcagatttgatgacacagatctacatccagtggtctgattatggatcctgcataaatagatggaaataggttcactttcaaacgtttaggcatcattggcaagactgacgcttctgctttctaccagtcataatatgaaaacattggcaatgacctttactagaaatcttcatgcaaatgcaacaagaaactcacccaaaacattagcagaacctaccagatctattcattagaagaaaatatcaaccataggtatcattcacaagtaagagaagaaaagcattagtcattttacctagtatcacaccatgggcttttgagttggcaaaaatgggaatgaatcccagcttcatgactctaccctgggaaagtgacatatttctgtgtctcagctttatctgttaaatgggaccaagagcccgttaccttgtagggttcacaagatgactgattgaaacaacatatgtaaaacacctaggacagtgcctgcatatagcatgtccgctataaatatcactccctttcataggcgactgctctaaaaatattatgtcatttcatagatgggtctcaattattttgtgattcattgcctcccaaagatcaatctacttgacacaaaggaaagatctagtcaccatgagacagaatggatattgaagcatacagacatttgactcaaattaatcaaaaagttgcatttttcagtaagtcagctattaccaagtgcttcttatgaatagttattttaagatgcagctttccagaaatactgctttcttaaacaaagtttcattccagaaaggaaaaagcctttggccaatttagaagaagctttgtaccattcctgggaactgctcagcatctggggttgctggattttaagatggagttctcctatctaataaagctgctatgatcattgaacacagacacatgtaagatgtgttggggccttggggacgtaaaatgatagcacgaggagggacaggaatctaaatgctttgtcgcacacaccagagcataaataattatcaaagaatgcttaggggaatttaatttaattctgcatgtaatgaaagatgaaaaattatcttttccattaacatcaattgcatcaaaatcagtatttttataattttctcaacctattttttttctttcaactggcgaagtatcaaaaggcaataaagagaaaaaaagtacttccagatggttggtctaagcaaattacatgcaattttcctttaaataaaatggaaaatatatgtaatagaagccctgctgaacacctatcaaatcaaaatgattactgtctgcaccgttgtaattcactcactggtttatggcctcactctatttcaaagagtttcccaaattcatataatgttctgcagtgctagagctggcatcagatctctgatgtagctgaaagatgcagactgtgaaatcttccattgttggacaactttcttatttgggacatagttgagaaagctgagcagccaaaaaataaaataaaataaattgtcctttcaaaggcagctttaaagtcgcactcactcagctcaataaactctgtgtttcaggggtaaccacaaaaagagaagactttctacttgttgttccaagtatacattttacactaaaccctatgctatttagagagatattggtaaaaaattatggcagtgggtcatcagatgaggaattccctctcaaaacccttctagataaactgactctcaattcccccaacctttactcaagaaattggattttatgtgctccatccttttaccctaaaactcattagtacataaatgaggagaaaaagttgagaattggagaggtgggaggtcagggaagatagagggtcactgggggagtggactgtccactctaacccgtttctgatcactggtatccacagaatgaaccccaaagccatcgcccatcaaagggcaggtcccacacttcccagcaattagatccaggtggaggtgagcctctggtggggtggtgcggaagggcagagccaggtaaccagggtagtcagggcatgcctacctcgcccctaccccagagcctctcacctgcaaactgggtacaagcagttggtgtaaggtcaggaatgttgtcaaaggcaacatgaaagttatagtgtatcaagttcaagacctggacttcacagatttatggctacataaatacacacaatgtctttatgaatttgcccctgcttttaatttagtaagagaccttcaaagcaggagttcaaaaccaggggcaattttacttcccctcctcaggaacatttggcaatacctggggacaattctggttaccacagtgaggggatactacgggtatctgtcaatagaggccagtgatgctgataaatttcctataatgtgctaccctcactgacaagaagggattatccggtgcaaattgtcaatagtgccaaggttgaaaaactctgctttacactgaaaaaaagagagatggaatttaggtagcattatgttctgtaagtagaaaagaaattggtaagaccagaatctcttaccactgaaatgtttctcagctgctaaaatagggagcctggtacactcattgaacagctttctaattttcttttatatcctacacagattttctctttattctgccatgcagaaaaataagagaggccatttatagcaaccatttgaattctctcctgtattattttaagatgctgctgcttttacattttgcccataagaagttttactagaataaataaaaccagttgtacacaattcacagacaattgttttccaaaggatttttttagtattataagctgtaacctctaattaaatatgtgatcccactggattttatacatagaatatagttaccatatttacgtgtgcacattatccactttactaacttttctaaaatttctcacataaatctgaatttttaagccttaagtgggatcccaatttgtacatttttctttcaactatccatatcttttgatagtgaatagaccagtcctcagttactccttagcacctcctatatttgcaatgcaggacccagtgattacttctattacttctggtagttctcaaagttacaaggaacaagaatgatcatgaaggttcaattcacctgattccataatcacattctttgctcttgagacattcgccccgttacttctgtgccttgtctttatcaccacaaatcctccgatcagcacatcccttgcctatcagcctctctacttaacaacttcatttttacatttattacatctttcctgccagagtcagtttggactactataataaattaccatacaccaagtggcttgaacaagagaaatgtatttccctctgtttagaaggctggaaagctcaagatcacagtgccagcagatgccatgtctgagggagctcctttcctggtttggaggtggtgtcaccttttgtatcctcacatggcagagcagagcacaggagcaagttctccagtgtctcttctttttttttttttttcgagatggagtctcgctctgtcgcccaggctggattgcagtggcgtgatctcggctcactgcaacctccgcctcccgggttcacgccattctcctgcctcagcctcccgagtagctgggactacaggtgcccgctaccatgcccggctaattttttgtatttttagtagagatggggtttcaccgtgttagccaagatggtctcgatctcctgacctcgtgatccacccgccttggcctcccaaagtgctgggattacaggcatgagccactgtgcctggcccagtgtctcttcttataaaagcactgatcccatcatgagtgctccactcttacaacctaatcacctctcaaaggtccaccttataatactatcaaactgggtgttaggatttcaacatatgcattttgaggggacacaaacattcagtccataacacttcctatatgcaaagcagagcaaaataaaggcaaatactacattttcaaagttatttgcctcagtagcatcagcatttggttccagctgtaatcctcagccccctcccatgatggtaatcaaaggcttgccatttgctggaaattcctgccctgcaataggagtgttcttcaccctctacatctgacaactgccctccacagttcacaaatactgacggcgcactaaaccataagctctttaggaacaggaactctgacatatatgtatttataccccggagagtaatcaaattgtactacatatactcctggtgctgatgaggaccagtaatgagacagatagaatgtatccagagacatctgttggtgctaagaagggctcaggcaggtaataggcatcctaaccatttaggacaaagtaaaggacaaataaatctccaattttagtcatttattttcttccgctagctttcaggttgatgtgttctttcctagttcctttaggtacaaagttagattgttaatttgaaacctttctaaacctttctaacttcttgatgaaagtgtcttggggctacatgctttcctcttaacactgctttggctgcatcccagagattttggtaagttgtgtcctcgtattcattgatttcaagcattttttttttatttctgccttaatttctgtgttcacctaggagttattcaggagtaagttgttcaatttccatgtgtttgtatagttttgagagatcttggcattaatttctatttttattgcactgtggtgtgagagtgtccttggtatgatttccaggtttttgaatttattgaggcttgctttgtgaccaagcatgtggtcgatcttagaagacagtctgtgtgcagatgagaaaaatgtatattctgcggttgttgggtggagtgttctgtagatgtctatagaaaatgttttggccagagtgtgtgcctcacttagaaaggaaggggaaagatagaggaagggcagtgcaaagtcatgttcaatggtcatggtcagtgaggcaaaactgcatctctgagctcaggatgaaagaggatgaggcaacgatggtcgaggatgctgattacatctcctaagtacaggttttaaacatgcacacatctggtcaacctcttctgattgtgtgcaaacctaaggagtcacaggtgggccctgataaggtcatgagataaaatagggggctttatgtttcctagggcatgcatgcacacacaagtacatggcagatttaacattttataaatgacacccaaataactcctgtttatcatctgggagcattccatttttttctcaagaatcattgtatgacaagatatggcaaagctcaaattaaatcaacacaacgaataaccaacaaaaacaagtgaagtttcagaagggcaaattaagaacaacttttgtttttctgtggtgtcacacagagaaaagttatgtctagagtagatactctttgatgtacatcccaaaagctctattagcacatctgcagccaaaccactggtttcaggatgtgtactgttgggcccctcggtggccatattggttccagatggagttcaaataacataagggcctttgttcccgggctgaactatttcatttctccactggtaacttgcacacatgatggagcgctccatcatgaacgatgtgcaatgcccaggggtgcttcaaaaaatgtaccacagagactgctaaaactcatggaagcccctgcttttaagtgatagcagcagcatttgccaacagagtggtgctagtgggctgtattacattccatctttgtttatgcaacacccctggaataaaaagttaggcatttaccattataatttaccttaattatagtatttgtcactacctgtaatgcacaaaagaattatggtagttgcactcatagaagaggaaaatgagacacagggagcctttttgacttgcacagggttactcctatgctggagagaaggggaaatattaaataccttacatcaaatacctaagggcagacttaaggatttctaatccactgctgctgactgctggtattttaagacgggaactttcaaagaagaatgaatgttgtcagaaacatgattcctaacataaggaagcaatgactgggggctgggagatggcctatatcccttgtaagagtattttgagccctttagacaataggaaggctctctgacagtcttacttgtcaccaggcctctgctatgtccagaacaacagggttagaattcatggccccgccaggcatggtggctcatgcctgcgaccccaacactttgggaggtggaatcaggtaggtcacaaggtcaggagttcgagactagcctggccaatatggtgaaaccccgtctctactaaaaatatataaaaaattagccaggcatggtggcgtgcacctgtagtcccagctacttgggaagctgaggcaggagaatcgcttgaaccccggaggggtaggttacagtgagtcgagatcgcgccactgcactccagcctgggtgacagagcgagactttgtctcaaaacaaacaaacaaaaaagaattcatggccacatttccaaaatcttcatacttttgcaagctcactgcctatttcagggccatttctttgaacttatttcttcccctacccacataatcagtgtgaacagtctagtgtactgccttctgtatcttcctccatgtttctgcaataacatacaaatacaggtattcagacatgggggatggaggtcattttactttataatttgagattttctcataatatcataaaatctctccaagttaaccaggtatgattaaaattaatctttaatcacatctgagacattcttacaacataactgacatataatctatacttgattggtacacattcaatatgtgagatcaatttttgggagagaggaaaggaagcagtaaaaaagcttctataaacattcactatacatgcccttatatatgtatgctggtatttttatttttacaatatatatgccctcatatattatatacgggtgtttttctttgtatagtacatattcccaggggttgtaatactgggtgaaatagtttgtatatttttaattaggattatcaaaccacttttccaaaatatgtaagtaattcatgtttccatcagtcatgggtgaaagtcccctttaatcagcatccttacctgtcatgggtgttatcttttttctctctctctttttggccagtcagaagaatgatatctcatttgaattatcctaagagcaatggatagaacattgtttcatctacttactggacatgaggatttgctcttatgtgaactacctattcatatatttttcaattttcttatgggctgcttgaatttttctcatcaatttgtaagagctctttgtatattagaaataccaaccttatgcctattgcaggaattgcaaatattatctctatctaatgttagactttttagatggtttatgtcatcttttagcacagtttagtttaacgataaccaaattacagtctatcccttaagttgccaaaaagaaggaatcagcagaaaattctcgttctgcaattactaagataaaacatccagtgaaagaggaacttggaaaagatccagtacaaataaaactgcatgttcaagaatgctttcttaacctttggcacagatgccaccttgccccctccttggcttataagaagctgtcatacaccatcattaacacagttggtctcacccttcaatgcagatgttatagggtgctgctcctgaataattcttcaacctgggcaacgcatttaaattgggaattttcagctataattgttactctctgctgtccataggatgaagtctttgacccgaacctaaatacagaccagaattctgagcccaaaaactatctccagcatccggagaagaagcatcatgaaaggggaggagagagctgtttatatataaaataagttgaatttgcaagaaagaaccgactgtctttttctttaaaaattgtaggtagtatcaaagtttttctcctctttacagataaaaacaaaaaggctaacggaatgcagtcgaccgagaactagtttcttacatttccattgagggtatctttctctagatctgtcatttttcagaattttccaagtaataaagtcacaggcttttttgttaggtggctggaaagagaaatgtatttgtcattctgtctgatcttccaaagcatttttcagtgttgtttttgttgctgttatcttgttgaattttttatcagactattattggtatcaccaataaagaggatgttgaattatgtttctcattccaaaaatagtgcaaaaaaattaatcttaaaaagtataatggaatccacttttctttcactgactccatctgcaagccaggatcaactgtaaaatcattttatgaagaagcaatattgcaggggatttattctctgggtctaacagactgcttgcaagccagcgttaaagaccttgaacagttgatgcaaattccacctttgtattttactgccctcagtgagctcaacatcattcattaaagggtgtattagctgatatcttaccaccgccatgcagcagagaaggagaatcacataattttaaaattcaggctgagggccactgtggacgcagaaggctgacttccgaccacctgcttccccactagacttgttccaaatggctttcttgagaggtgattcacaagtgctaaaaaatcacgaatttttaaagtgagatattttggattacttataaactactttccgtaatggcattttaccaatgaaatgatccactggatgaaaatgacttatccttagttatctgttttattcctgagctcatctattttgacaagttcttgatcattgtgcagtacaaactatgcgcagccttttcacaaaggcttccctatggattctaggagctcacaacccaccgcttctcaacagacagtcatatattctactttacagcagaatacttctgcctcagggaatcctaatggccagtgccaaatcttgttttcactaactgtgagaaatgtgagccttatgctttacattaataggccaaatgtatttctctttgatagaaaatcaaacttctaagccactgataaaactctggtgacatcctgagcttcacaggtttgatcctcttacaaaaggtgtgaacaatgcaagtgaggttaacaaaaatccttgcagggaatcacacactgagtggctctctggcctgcatcactaactgctgcattttattaacagcaggtcaaagagcctctcgcccaacacatcacaaatgttcacagagattcaatgagtcaacaagtatgcctactgcagctggaactgacactgaaaatgtgaactacattgacaaaaattctcagcaggcctctcaaacacaaacttttccctagcccaaggtctctggggaaaaattataacaattaaaagtgcagtgtggagtgagaacacagtgcagcaaatttttaatgtcagaaagtagcaatttgataactaagaaaactggaaaaatcattataacctatgccttactttgcccagcacctcccaagactcaactggaaagagcctggctttgagaagaatgaaagcctgaactgctgattgtgagaaaaaaaaaggcaaaataagtgctgaaaggaactcacatcaaatatttcattgtaagagtctgatcttatttcctatagccagaatggcatttgacgatacaacagtggagaattttgctactaagatgttgaatgaaatccctcaagaggagaattacctttgagattttctgtcacttttaagatcacttctgaagtatcaaagcactactatagcaaatgaaatattatgaggagctttgcaacagatgccaataccttcccaaacatgtctgaggcatctcctaggtcagaggccctggatttcaaacatactgccaatatgtcaatgacccccagatacacagctctattcccaatcattcctcgatagcccacacttgtgtatctgtctactctctagacccgatgagaaatgaaagccttcaactcaaagttaacattgccctagaagaactgttgcgtttccctccaacccctatacctccccagggcttctctgtctcagtaagttgtccaccatccactcacttactgaggtccaaaacttccaattcattcttaatttatcttcccctctctccaatgcccaatccatcagagcaccacagactctacctctaaatatgtcaagcccatccacttttctccttctacactaacaaccctgtagtctgtgccaccatcacgcctgaccccatcatctgtgagagcttcaagctggtcttcctgcttcccctctagctaccctggaatccattctctgacccagtggtgaccttgataatataaccgacaatttggaaacgtaaataactcatatcccaccactgcttctccaaagggttcccaatgcccctaatagacatagaagtttcatgtcccggcttacaaagccctacatatgctaacccttacccacctctgtggtctcaattcacaccactgtccctttccccactacacacaaaccaatccaaagttgtcccctgttcactctctgtcacatgaacccatctgaattctttgcatagcacttaaccactggacaatactttttttatttattgtgaacgcaattattgcttatggtctaactcttccaccaaaaatgtatgctcagagagccaggagcctatctgtcttgcttacgtgcatatcgccagtgcctaaaaccgaggctcacacactacatgtgttcacacacacacacacaaatacctggggaggagggagaatgcaagttatttctcatggtcactttgactgcaattttcaagaaaagcagtcagtgtgtgacagcaacagtagaagcacgatttccaatcagacattaattgagacgaccactagcccttggtgaccccatgtacaggaagagatgtttcagggacaccatttgtttatacagatgtctgtccttaagggatttttgtttgaaatcaaccaccaatcatgtattttctgcaaggaaattacacagtaagggtgggttccaaccctcaaaatatttgctagctcagtgaaataaaaccaagattccatttggagaaacctatagctgctttactttgcaataaattgtaaaataggtgggttttattgttttataattcttttctgtaatagtctaccaagaggaatcccttggggacctttagaaaataaaaggggtaaaacacatgctgcattaagaagttatatattatccactgggctcagccatgcaggaggcctcagcatgaccttggcaagtttcttaacctcaccacactgttcactcacctttaaatggggataatattagaacctgcatgcttgttgagaagatgaaatggcatgcataaagcagtatctgggacacaggaagtgctcagataatgtaagcattatgaattatcaccaagttattagcagtgcttcaaaaaatatttcagatttggaaatgttggaaaatccacattattaaatttgtattgtggccgggcgcagtggctcacacctgtaatcccagcactttgggaggccgaggcgggcagatcatgaggtcaggagatcaagaccacggtgaaaccccgtctctactaaaaatacaaaaaattagcctggcgcggtggcaggcgcctgtagtcccagctacccggcaggctgaggcaggagaatggcgtgatcctgggaggcggagcttgcagtgagccgagatcacgccactgcactccagccctggcaacagagcgagactccatctcaaaaaaataaataaaataaaataaaataaaataaaataaaataaaataaaataaatgtgtattgtcattgctacattacaaggaactgtttaatgacttgctctgagcatgttcaagtgctcctttggctgcaaacacagatgactaccgcaggcccgtggaggtgacccaggattagctacactctattctttctacacttggggaactggcatgtgcttaagaaaagacaagaaaagctacttcaaatcaataaagtcttcacaaatcatgcacacgtgattagaaatgttcgttctgggtgtatctgatcatttagtaattgctcaagaaaacaagaataactttgtacattatctgccataaagacaaaaaatgagcaagaaaatgagagtcaaagttagaaaacaaacaaaacacttaatattataatcagagaactgagtcacactgtcataattcacttttttattgttgctaatattatgatgtcccagaagacacttctaagacatttacatagaccttaacacctggtttataaaataatattaaaagaatatagtccagtacataaaagagaaagttattttaaaaaatgaaattggccaggtgcagtggctcatgcctgtaatcccagcactttgggaggctgaggcgggtgtatcatgaggtcaggaattcaagatctgcctggctaacatggtgaaaacccagctctactaaaaatgtaaacattagccaggcatggtggcaggcgcctgtaatctcagctactcagaagggtgaggcaggagaatctcttgaacctagaaggcagaggttgcagtgagccgagatcccgccactgctctccagcctgggtaacagagaagactctgtctcgggggggaaaaagatgaaatcaactcctagaaaatactgcagcagaatgataaagtaaacatacaactacatatcaagttgagtcgagaagaaaggaatttcaggaaaatacacaaaaatgatagtggcttgggagaaaagaatagacctgcctatcaaagcatgtgttggttctctgatgaggtttcagcctgagaactaacatgggaaatgtgctgtccttctcctgctttactaaccttctgccttcttggttggtgcatccctgtgccgggctgatgaatacatcacaactgctgctcacagctgggaacacaaccagtaataaggcacagttatagcttcagggatgtaaggaaggtgagtgactgtccatactgtgcgtgtgtgtatccacagtcacacatgtgtatgtagcaccaagttagtgaaaaggttttatttaaaaggtgctacctaggttgtgattttcctctagtaggtggatccttgagcagcctacccctaatttgccacaaattcataattaagttacatagctgggtgttagtatactgttttacatatagatttcagagattttaaccctgccttagtgcacctaatgcagtagggtttcatccaattataaggctttctctatctgtttctatatctatttatctatctctatataatttacatacatgcatttatataggtggatattctatctttctgtttattcaactctatctacatatattacatatatgtgtgtaaatatatatatgtgtgtgtatatatatatatatatatatatatatattcaactctatctatctatctatctatctatctatctatctatctatctatccatccatccatccatccaattgacccagaattgtggtcacagcaaggcagatactcttaaacattagtgctgtcctctggacatgtacatccagataactatgttacaggaaatacaatttcagtcttctgagcttggctcaccccacaacctgacagtcatgctgtgctgcgctatttttatgtttaatatgtactccttgaagatgatactatgaaattccactgtaacactgatagtgttcaaatgctcactttaagaaaggttagatgccaggaaggaagtgataccgaatcctacagtgcaggaaagcagctacattggtttcggtcttggtgctatttgaatacctcaccttccttttctgttctcttctacatctcatagataaccattaataagaaacggactttagaaggatctcacagtctttcctgtctttggtacactgtaagtgatgttcaattacactggaaaacagtgaagactatttgagaaagcagtaaaatgaatggccccagctggacaatatggggacagtctataatggctacagcaaatataattatttaattattgtaaaattatgcaataaacttcttaaactaaatatagcacaatcagaaggctagagcagtacatttaatcacactcttaaggaccattagagaagttatattttacaaaatttccatctgaatcacttcattaaataacatatacgtattcagtgcttattatgtgccagagtgttaagtattgggaagacggatgcaataatcaagccaaggacttcacagtgtgaaaaggaaggactatatgtatttacaaaatactacaatgaatcctactttaaattgccattgcagggatgtgcacaggagtgtggggacacagagggggtgtgacttaattcatccggccatggagaaggaagagaaaggttcatggaaaatgagacagattagctgagaactggtgaacaagcaaatatctacccactgaacaatgtgggggaaattataccaaatgcatgaatctctgattggggtgggggaggaagaatcccattcctcttctcttagccaagcccatagccttccagctctgtgtccaaattagaaatagggtattactcatgcgattcagaaagtcccagaaaaatccatccatcaacccatctacacaacaaataattattggcatcttattacatcttagtcccttacctcacctaggaatggagcagtgagtgaacaaaataagcaaaatccctggcagggtagagcttacatgagaaggcaggggcagaagttatgtaaaattgataaacaaaatatctcatgtatcagacagtgctaagttctttacaagaaaagcaataaagcagaaaaggaaaatagagaatagcagggagactttccattttagtcatttgatcaggaatatctcctgacaaggtaagagttgaataaacttgaagtaggccaaggagcaatcttcagggatcttcaggtaaagagtgctgcaggcacagaaaggagtcagaatgaaaagactgagcaaggaaagtggctactctgttccagggagaccaaggaggccagtgaaactgaagctggtgcttgggagagaaagatagatagagaagagagaggatgaggacaaagaagggacacgtggtgcctggcgcaccaagggaggaagctggctttccatcagaataaggcagcagctgctggaggattctcagcagagagcctgtctggtcactgtgtggagaaaagaccacggaggcccaagagcagaagcagcgagacggccggaagacctgagaactcacggggaccaagttgctgggagcttagctgaggcagggagcagtgaaggtgctgagaagtggtaagatattggatatatgttgaacaaaaaaacgaacaacaataagatttgttgacagctgggatgtggggtgacagagaaagagaataatcaagtattgttccaactgtttcagcctgagcaagtggaagactggacttcccattaataaaatgaggaactctacagaaggacatggctaggggttgtggggagaaaagagttcagtttggacatggttaatttgaagacataaattagacatccagttgtgaggttaaataggcagttgaatatataaacaattctggagcttagggataggttttggctgaagatagacatgtgggagtaattagtgtgcaaatgatactaaagccatgagactggaagagatttctaaatggtgagaatggtgggaaaagagacaaggtccagacactgaaccttatgggactccagtgcttggatggcagggagatgaccatttgaggctaagatgcaaagcccagagatatgaggtcaggccagagaaatggagcatcctaaagccaagtagagaaagtatgtcaaggaggtgggaggggtcgatggtataaaagctgctaactgttaagtatgatgatgactgagcctcgactgctggatttagcaacatggcggtgttgggtgatcttgactaggcagtgctgaaggaatgactaagggatcagactgggctcaaaataaaataaaaaggcagaaatggaggacaacaagtacaggcaaatactttaaaccaagttttttttgttttttgttttttttttagcaaagaggagataaatgtattataactaaagaggaaattagaggccacaggtcaaattttcttaggatgatagatgtttccattcctattggaaaaaaaaataaacagcatagagggaaaaataaaagctgattatgtaggaaagaaaggaaataactgcttaagtactgtaggagcaaaggaatgggatacagtttggccaaactagggttaagagtttccatcagaattaatcagtgtccactagctggaatattgtgattggcccacttgggtaggtacctcacctttaaaacatcactgtagtaaggaggtggcctgcaatgaagaaaagaggaacagttctcaaaaagtatgtggcccctgagctgtgataagggtaccccaatttatatgtactaaaaaaaatctgagctacagtaaacaacttagatcaacccacttaattcctcagcactggaaatgtaagtgcactattcttagatactgttacatgaaaatgtggtgatatttacttcccagaatctcccaaccaacttcccaacctttgctttttctgctttggtttaaccaatagtggttactgctcaggctttaaacaaaaacaaatgaagcaaaatgactctgatttctttgtggcctcggaggctcaaaaagacacaaacacacatgaaacccccactagctttcctagataaagcatgaactgattaggtttgcagccctgcagctatagaggcctctccaatactctgatctggaaaccacagggcaggaaaatccccaaagtcccatgaaatccaaagatccaaacgtggggtcgtttttatgccctcaggaaagttctgccaaaaaaagagatcttacacacagtgtaattgagagggcagtatccttacgtgcacatgtaaatccaaatccaagcaattaaccccacacacatctgcccctctaatgggtgtctgagaataaacagcacacgtcaatccctcccagcctcactcaatcacgaaactaagaaaagaaaatgaattctgaacttcaccacacagctgtgattcacaaatatttatagtagccataaagctggtgaccttcaggaagataacacacttggcagacattcacctaaacaaaagaggggaaaaggcccaaatctcaaacagcagagaacagagagagaggcaagatttcccaagttccataatggggaattccaatgcattctgatggagataatggaagctgacaattctcctgtcagtgagctttggtaagcggagtgaaatgcttgtgacaaaacagatcagctctgcacgggcctttctggatggcctcacagagattttccatcaggctgagtacacaatcggatgggactcaggagtggtgtctacagccctgtatttctgacattattaggaatgacaggctaaacctttatcccaaattacaaccactcagcatgtttaagcaagtgtgtaccttgtatcaacaatatacatagagatgccctgaaaatatcacaaaataaaattcctttcaggaacgtggcaccgaaagaaacaccgtcagcaactcagcaagcactttttttttcatatttggtctctttgtctagtttaaacccctcattacctattatcacacccaaacctatgtcttctcactttccttattttatagccaagaaatctaacaaaatcaagacaagtaaagactgagagctgactcttggtccgatctgtccacggtcaggtggttatgaatctcaaaaagcgagatctagattcaatcttttggaactcctgcccttaacattattgtacgcacatcacaacaaattactattttacatcagtgctcgagactgcacaaacgaggacatcttatttgtgatttgaccagccttaacttggtctttgatacccaccatgtaacatttaatgcaaacaccttaagttagctacaagaatgagccaagaagcaaagcactgtgatcaggatttaatcatggttaatataatgggttaagttctataaaattttttaaaaatgaaatatagttgttaaaatatagtcataggttatataaaatcttaaaatagaaagttcccttctccctaacgaagaatgaataaaagaatgagaaaatttaagttgtctggttctaaactaggtctctatttgtagaaaggagaagtgtgtttctgggattttctcccacttgtacaaatattgttattgtccgaacatccacaataaattaaaattggggattgatttttttcagtgaggacaaagaaaggcagaataaaacattgagaaggttttaaaaagcaaaactatattttaaatatctgttcctgaattaaacagttaaatatttttaatacaatcagaagaaagtaaagaatttttgttcatttttttactattcccattttatagatgaaaatgttttgttttattcctaagcactgattaaaatcattatcaagaaaaaatctgacatcactaaaataaacttatttaaatttaaaaggataaagcaaacaagcaaatgaaatagcggaaaaaacagtgacaataatgagttaatattcttaataattaagccttaaaatctgtaagaaaaatgttgagtctctatagctaaacagttataaaatctggacaaataattctcacacacgcttgtttgtctctgtctctctctttctctcccacccttccctccctccttcccttcctcctttctctctttctctcacctcttctcagagtaatggctaattattgcttgaaaaaaaattagcaaagaaacacaatgagtaaaaaataaaatatataaaaaaagaatattatcaaattgactaaaacaattaataatactactcaaagtttttgagtaatgatattcaaatttgttttagcaaaataaattctccagcatataaatgaagtataaatatctacaatacttttacaaagccaactggcagatttttaagactccctgggttttatgtagtaaatcaaccatagctcttctgagctaatgaattaaccctcaattaaaagaaagtattacaataacaattgctattgtttttgaagcatgtacttcatgcaccaaatacagtgacctgctcaaaatgagaaagcaggattggaactcaggtgtatgaagtctcccatcacccttttcatgttcatttcagcatggtctatgacttttgtgaactggaagcaacatatgttccacaaaagaagcaggaaatgacattacagtgcctttacacgatagagtattacatatacattaaaacaagggttttttcttcaatttgcaataatatgagaaagtatgtataagtgaaaaagcagtatgcagaattttatgtctagtattatctcaactctttaaactgcttatcaaaaatattccataaaagactacattaaatgtcgtctgtgattgtcttcaatagaggcattatagttgaattttcctcttcttttatatattttcagtaatgagcattcactacattaatgcactttaaaaatttttttaattgtaaaaataataatactcctgaaaatcttactgaccacatggatgataaagtgcaaacacctgtactccagagataatctctgtttagagtatggtatatattaatatatattctaggagactttataatacacatgaacttgtgcatagagattgtgtgtgtgagtctgtgtttatttttaagaggaatgggattatattaaatatattattctgcaatttgctttctcagttaataaggaatcaaggatagttttccattacttttatggtcagaatttcattttttatatcattgctattaaggtgaagcacactttgccatggcacatggaataagtacctaggggccagtgctccttgacaaaggcatgtctccaaaacttctgctatattatcaggctcttgagtttgctgcaattatagatttctaagaatgaacgaatgaatgagtacaatagttccttgcttaaattgcttaaagaaacacaaattaattggtctttcaattttctttgcccatctttgtaaatgatatagtagagagtcaaatatgcctttaagtatcagaagtatccgtttgtaataaaaaagaaaaatttaaaaaatcataccacaatttatttatgtggcaaagggtattgccatgttatttcatcatttaactatgtcaatcctgttcaaactccatctttgctcataataaaagagggatattcgagaccagaccagaacattcttgttcaacaaaattatcagaaggcccaagataattgcatgtttaccctaatatatataaaaggcagtatgtataagggtgcaaactaacagtgtcacattcagaaactatataaaaaccaaagtaggaaataccatctaaacttatttcataaatgagttatatataccagcttaacaaaatgtcaagaaaataatatttaccaggccctaatttgagcaaagctgtaatttaggtgggacttagactaacacatttggggcatataaaccatgtcaagcaatagaacatcaaatgtccttattctaaggggtaaggtttgcagttacaatagacttcaataaaatttgtttataattaaaatccaagcatccaagataaattgcactgtgggactaatacctactgtccccgaaacactctcattcactatactatgaggtcttcggcagtgcaaggatcgtgtcaatcatagctcagaaagctgcttagcctggaggccaaatccagcccaccacctgtctttgtaataaagttttattgtaacacagccatgcccattcacttacatacctatgactgctttcatactacaacggcagagtgatgcagcagagactctatggcctgtaagcgccaaaatgttttctcacactttttagaaaacgttcgccaattcttgatttagattactgtttgaaaaactgatttcttaatatttgttctgagtttctctctacaggtctgagtaactccagtaaggaataaaaactaaaatatgactgttcttattctagggaggcatggttagtgctaaaaggcagttttctgtaaaggttaagaagatagaatcaaatcccagctctgcctctgactcactgcaattctcttgcagattatttaagctctctgtgcctcaatttcctcatctttaaaacagtgacccaagaatacgaacctgaaagggttgttatgagaattttaaacatctcactcagcacagggcctgacacacaatgaggacttacattagctaataactcttcctatcatatatcatgataaccgctgaccatccaaagcaagccaacacaggctccatgtggtcattcttccagctctcaggtgctgtggttctccatgggggagggaacgggaggttccggttaagacactatgtgaacctgaatctacgtgggctggagaaagatacaaaatgcagacctccgtttcttcttctgcaaaacgtaaggacgacacaggagaacctctcgtctcagctgagcacatctacacatctatacagagggcccagctctaagacccatttagcctccttcctcatagacgaagccagggactggtaactcataatccaagagcaggaatggtcaccaattattcagaaaatctctggattatctaaaatcagcaaagtgttttgtgaatggggaaaaaatataagcctgtccacaatgagacggtaatttagttagggagaaaaataaataagttaataaacaatggtagtgtctttgcagtgactagtatatggaatgaaattgtcactttctctcactttacttgttcctcccctacacaactagtcctctatcccccttcaccccttcctctcttctagccttcccagaaggtagcaacacctaggtctaaagtgcttcagaaaggctcctgtgaagccagcatttctgagccagcctttggaagatccaaacaagcacgattcgtggtgggaacagatcattgtgaagtggggggtcagtccctacactgtcccagggccacaggaaggaggaaattgtgtggaggcctgaccaggaggatccctgagagtatcatgagaggtttagggcttacccagcaggtacaggggactgcagaaggtcccaggacaggaagtgagatgacagtggtatgcactgcaaataagtgggggcagcgcacagaggtaactgcaggagacaaaactgaaaccaggtaggcagtcacactggggcgcagaagatgctaagaagcatctaagccttttcacgtcttcgggttcctgagtgatgtagcggtggtatatgcccacaattgttttacttgaaagatttctctatctgaaagcttgctcattaactctcatttttttttcttttcttcttttcttcttttcttcttttttctctgagatgaagtcttgctctgttgcccaggctggagtgcagtggtgcaatctcagctcactgcaaactctgcctcctgggttcaagtgatcctcatgcctcagcctcccaagtagctgggattataggcacgcgccaccacgccaggctaatttttgtatttttagtagagatagaatttcaccatgttggccaggctggaactcctgacctcaggtgatcagcctgcctcagcctcccaaaatgctgggattacaggtgtgagccaccaagcccagcctactcttatttttaataacagaagtaaagctcacaagctgtcaaaaatatttcaatctgtaatttttttagtttcttcacttcccatttagatgtctcacttaccaaggagagagaggatggaggacgcgtttcctcaatcatgaatcacactgactccacagccacgtgggcactccagcccaagtctcacacaccaacacttcaaaaaagaaaatagagagatcctgtcaacccattttaaaagaggatgtggtcattggtcatgagttctatgaagttccattaaagtcctaaacaatcagagcaagctgctttggccacgtaggattaaagcagtgacgcaggccagcttggcatcacaatcatgctaccctagttcaggatcatgtgcactaatggattctttttcttcagaaaaggagaaataaaacatttaaatgctgttaacagatgaaataactctcataaaacatccagaagaaccattatttcaaaattatcttaaccagtctgaaattatctaaagcagtctgaaaattaaattaagattcattatatgaatttatccttttcatgactcattccactttttggaacacatggtaccttatacaattcaagaacaggagacaaaggcagtagcacaaactctgctagaaatttgagtttgtatttttatttacatactgatttattaggtgcacaattatgaggctttataggaaaaggaatgatgcatcgtgaaaaacaagccactttaccaaaaccaagtaaacctgtccaatctcgtcattcaatttcatatacaaaaattctgaaaccttgatgttgtcattggatggaaagatgaccacgaaacgccagcctccctagaaacatgtatgccagaggctgaaaatataggtgactttccatctatgatccatatgagaaatgtgttcatcaccagtgaaggatgcctgtgacttcaaatactgcatttcagggctcatgcttttttctgttctcttcattcatctggtttttctctacacttcccaggtggcagcttctggctgctataaatgtgaaacaccctgacattcttcctcgccaccctgaagaagggaaaatgggagaaagaacttcccagaacattctggctgtccctctaggcagtgattcccacacggtcagcttcagtcatgatccgaggccatctgcctgcagaaaatgaactgaacgacagcagctggaaatttataaaatgttatacctgctgaagtgccattttggaagccctagggttcagaggccagggaacaggtcaaggtggcactgcctctctatgagtctcccttcctccaggacgggcctttggtatgttcatgggaagcaagggggtgacccagggcaacacactgggacatgcctgcctgagacgccccagcagcccaggcaccctcatatcgtgcagcacggccaatcctccagtcccagcagagtcctcaaaagtccgtgacatcatcctttggacaggagaaggtgcagatgcaaatccttgaagccaaaagaggagccagggaagcacactcagtctcagaaatattcctcagagtggccaatttcttttacacaacatcactaatatcacctttgggcgtggcaacaaaatatgttagttgaaactcctttattaaatggcatgtttgaatacacaagcatcctctctccagtcctaaaatctattttacaacaattattactaaaatgtccttgtagttgtttagatctgagttgaaatgtaagtaataaagtttgacagatcctctggttaccgccatgaatagctggcaatttctgtaagttcccatgtctcagaactacattaaaaacagggctaataggtctcctgcctcccccagtgaggtcacaaatgagctgatgtgaaccctcagctggacagcaaaaccacacctgcagaatatgggtcagtctcttaaatgaaagagactggggccaaaaagatcattgcaagaattcacaatcagtaacacaaccagagagcaaatactgcaggaagaagacatccctgccgaatccagcatggacagcccacagcctggaccgccagacagtcctggtgcaaccaacagactccaaaacccagccccttccttgtggaaaagcaatacccacaggacagagctctcttggcttgggggaaaacacagcttcctacagagtttgatgtctaaacaggaaatcagtctcagcagcaggattcaagggtgtccacccgaaagggttgttactgtgcctgtgtttacataaatagtgaaaaagatattttaacagcctgggggcttgtcagccaagtgagccatgttgggactttctgctcctgagggtcagcccttgcctggggaagacagggtgctcaccaacacacccatgtgtgcctgggaacgtgcactcaggaacagaaatgatagtgacaaagcagaggccttgagttggagccaagctagaggaacagacaatgattcttgcaggtccagaagcagagcccccgtgtcctctcccagcaaggtcataaattagccaatgcattaatcataaatcactgacatattttctagaaaactgagaagaaagctgaaaggcaaagaaactacaaagccccagaggctcactccagactggaagttggaaaatttttaagcgacagttaactacccatttaataagaaactgcttattttttataaacatataaatttctctatttgactcaattccatattatccttattcttttctcttttagcttagctttaaccttggtgccaacaacctctgaaatcctctgagtcataattttcagagttctgcctcttaaaaaatgccaccatgaacatatatgtgcagaactatcttgacgacacttttgatttacaaacagtaactctttcccagaagttttgccctgtggccacctacactcttcaaattgtctctagatggaactacatgaagaagattgaataccaattataacttactaagtgctcatcagcacatgactttctgctaaaatatgcaaccttctccctgcccaacttactcagaatgaggtaagatgtagacttaagcattattttggagaccaaagttgagctgagtggtagcctttatcctgcagatacatggcagaaattaacatgccaggccagtcttatgagctgaatttagaaaccgtacaacagtaagattacactggaaataaaaatggacaagaccacctggcatcagaaagtttagtggagtgatgaaaagaaaccgtaaaagatacaggttcaagaaacctaagaactgctgggccagcatttcccaaaggcaagacttagaccagtgccatggcatttaattgacaggcctctcatcatcagtccctccgttaatcaccatgcacagcacagccccatggccacacatggtggatgcttagaagacaaaacaagaacctattacactctcaggagctgtctatatgatttttctgctatgtagttcagtatatactatgaattggaggaaagagaagttacttatgggcagaagagtcaaggaaaagatttctgaaaatgggaaatgtgatgtgggctctaagggatgaggaggagataaggaggatattaaaagacacagtgaagtatgttttagtgggtgcattgcaggtgaaacaaacagtagatgagggaggaacagctgaaagtcatcaggtataagagaagagccatttacgccagcaccatggtgagttaaagcatgagttcctggtaccatccctggagttgggtggaaaccccaccacggagcccaccaagataagagtttgcaggagtgcaaactgaatgagataggtgaaaaaaagcaattccacaaaggtaaaaatctggactgcaatgccataagaatcacagacagaaatctggcctcatgctcaagtccctggaggaagacaaggaagtaaacaggagggtggattccaggtggcaggccaaggagcagggagggtggcatcaggagtgtgtggaggcagccagcatcggctagcagcagcatgtgccacgatgactacctgcaagatcactcacatgcaagagcatggagagctcaaaagaggcactccagacagctaacagatgggaaaagtagatgacacacagattgtagggaatgttaacatgagaaagagatgagacttcatccaaaggaaggcagagtcactgaaggttcagtgggatgtcaggatgagcaaactttgggagggtgaatatggcagctctgcagaggatgcacaagacaagaaggggagaagctggggtaaaaagccgccaccagagaactccaggtatgaggagaattgcagtgaaggatgaacatggcccttgccaagcaaaggacttgcctttgccaagttcctgggaagtcacctctaagaccttagaatgtcctgcctgatgagagactttgttttgggggggctttaggccacacagatagtctaggctaaccatgtggttaatggctgagggcttgggcctctctggattagtctggccatgtctatgtggtcaattctcaataaaaactcaggacaccaaggctcaggtgaagtcgcctggttggcaacaccctatgcatgttgtcatacatccttgtgggggaagaagcactgtccacgtgtctccactggaaagagaccatcagaagctcgtgactagcctctcctggactccagctatgcaccttttccacagctggagtgtaaagggtactactgtaccctttgactgagatcaaccataatcactaatacaacaggttttacacattcttagagttcttcatgtaaatcattgatcctgagggtgcccatgagccacatggcaaacagggtcagggggccccacatgactaagtgtgcagcttcagccctaaacatcaacatttaaaacccaggagcaacaaatggcctatcgcattggaattattcacaaagaaaatatattccacattcccagaaatatattaactatctaaaatagattttaaaatatgctaaataaaaagtcaaaacatcacagtccatttttgcaaagaatcacttatatagaaacatcagtctaaaaactcagcatgtacttactgaggaatgaatgttcttgaatttagggcaataaactaaatgacgaaaatcagaattttctcagtaggaatgaaaatacaaaatgagtaaaggacactatttttggaattgccttcatccaatgccaactggtttgattgacaggaactatgtggaggacccagcactcagatgtgggctgtgggataatgaaacgccattcactctggttatacgcactgcaaccctttctgtcactgtccgtagcctgggtgtccaggcttccattaggtcacttctgacagcctctgtcacttgttccacaggtggtctccacaggaatgtgcttggataaatcgacagtggacatttaggataataatgtcccttgaaagaatggcaatctctgtggctgggggtccttggaaaccccagccactcaagaaaacaaagagtgggtgacaggaacagagaacaaggctttgaggcaaaagttatagggaagaaagcagagagaggggagaggggaggaagagcaaaagaaaaggaagagggggaagaaaaacaccctagaagcagctacagggataacaggatgtcctgaaatggtgcagccaactgaaaaatatgatataatctatcattataaaatggacttttattgtttccttcaacttttgttaaaataaattttatggaaaactgaggtttacaacatgatgtaatgggtgacatatagatagtaaaatggttactctagtgaagcaaattaacgtatttatcatctcacatagttacattttttgaggtaagagcagctaaaatctacttatttcacaaaagttctaaataccatatatggttctcacgcctgcattagtatctttgaaggatacaaataacagcaatgtcagcttcaggtacgagggaggagggccagttcctggccattcccttccactggcagaacgtctgctgccagctaccaccacattcctgggcaaatattccagcattcaaggaaacaatttgaaaaggaaaagcaaaatgcacaaaagcttgaggtgatgaagaaattataggatgaaggcagcagccagccccaaccactcttaccatggtccagggagcagccgcataccccaccccttctctcctctacaggccagcactggctggggtcagaggctgatccatggagcaagtccattgagactcccaaatatgagattgctggccactttacattcaagacagggtcaggactcaaatgaaaaatgatgtaatttttaaagatagatctctggatttgttcaatatcaccacttaaatttttttttagtttattttttttaattttttttttatttccaaaggttattggggaaaaggtggtgtttggttacatgagtaagtgtaaccaaacttttgtggtgacttgtaagatcttggtgcacccattacctgagcagtatacactgcaacctatttgtagtcttttatccctcacccgctttccaccctttcccctgagtccccaaaggccattgtgtaattcttatgccttttcatcctcataacttagctcccacttatgaataagaatatacaatgtttggttttccattcctgcattactccacttagaataatagactctaatctcatccaggtcgctgtgaatgccattaattcattcctttttatggctgagtagtattccattgtatagatataccacagtttctttattcacttgttcattggtgggcattttggttggttccacatttttgcaattgcgaactgtgatcctataaacatgcatgtgcaagtatctttttcatataatgacttatattcctttgggtagatacccagtagttgcaccacctaaattttgaacggtatttgacattgtgatgtctaaatgctgagagcggagttagaaagagatgggatatagtgggcccatctcttaacggtttttctttcttaaggatgttcctttgcctcttggtttgcccgcaccggcctgaatacagaatctgtgcaggaccccagccaagctgtgcacagacaaacaggttctgaatgaagtggtgtctctagcagggacagcactgatgcaaacacccatggcttacacattagagaccttacacaaaatgtgggacaaaataaatgcacagagaaagaaaacacacacacatatttacaatcagatcgttatagatatccaataatattgcattccaataagcaaataaatggccttactttccacatcagcttgaacctccaatcagagaatttttcctgcatcccagtttagcatgctggatgttgtgctgaatgacgtgcataacaccacaatgacatgggaggtctctgccctcaaggaattcagcctttggaatcgcttttccccaaatcagaaacaatctcattaggaaccagctaatatttgatctagaaataattccacatatttaccaagaacatttaataaagaatcccttcggtaaatatctctcgtgccattaaaaaaaaaaaaagtgggccgggcacggtggctcacgcctgtaatcccaggactttgggaggccgaggtgggcggatcacgaggtcaggagattgagaccatcctggctaacacagtgaaaccctgtctctactaaaaatacaaaaaattagccgggtgtggtggcgggtgcctgtagtcccagctactcgggaggctgaggcaggagaatggcgtcaacccgggagacggagcttgcaatgagccgagatggcaccactgcactccagtctgagtgacagagtgagactctgtctcaaaaaaaaaagtgtcagatgtgagattccccttcactgagtctctggctcccacagggccaaagtaagaacacctggagaccagtcccagaggtcaaggcctcatggacaataagtccccatgtgatgacacatgacctcacacctgggtcatttaatcatgcaaatatctggctctatgactggcaggggcaagttctactttcctgtacagaagagcaggcacttctacaagttgtatccaaagagtaagatggcatgaaagagaaatactcttcccacttggagccttcatgcccagatccagcctgagacccctctctccatcagacagtagtcactgtgaatggaatgatctagaaatattaaacatagctccgagctaaagaaaaataaacacagtaacaggggattttgtttctcaaagcattgactaatcctaacaacagtttggaaggaagaaatccaattgttttccattttgtcttcatgcagattatcctttggtgaatatttaaagctagtagaaatagctggcactcagtattgcctcagtaacggaaataaagctggagtaaacacttcctatttcattactctcacatgagacaatgatgtgttctgaactgcaaagaggcatggggctgagggaaagaaagagagggggcaaaaatgacttctttattaaagcaaacaggttgccaaaaactaagcaagtgctcaaaatgagcaatttctgttatgcgctctctaaggacaccagggcctcagaatagtgaatactttcttattttggccaccatgtgccagattttcaaaaggccacctcacttttcatgcaggcaattttgaagagcttgcacaaccagttaatttgcaaggacagccggcctctgggcttccactctgacagctaaattgatcaatcctttgtagaggaaaatctcagtccctagaaaaaaagggtgtctgagaccctttgaaaaatgtggtctctcaattcctacttattcagaactacacagccaacaagacttattctgtaagcagtagtttgcctacacaaaggagactcaagatttaactctagatctaaatttaagatttaattttaatattaagatttaactctttaaaaaattatttgactactcttgttacttaactatctctgttaaaacataaaaaaagggctgggttcttatatccgccctctggtcattacatagaagagcgaaatgccggccacagattaaaccacatctgacaccaaacctttctcagagaaaaagctgagctgaggcagacaagtctgttaagaaatatgaaaacagagaggggctcatttatcccataaaagttggctaactgtgaaattcacaatgaattattagtgaaatggcaattggttaaattgttcagaaaaatattttcctaaaaacagaacaggcagtagatttttagaattttctagctacacactcagaaaagagaaatgaaaggatgtgctccttcaactcagtaatggaaagaagattagtataaacccgtgcaagccaatccaatgtgcatattgggctctctgtgacttcacttattttagatacctaagccctagtgtcactgttttacatggtatacaatgatctgggccaagccaattgcgttttgccttggaagacaaactctgatgttctattctggcttaaacctagtgaatgttctggagtcattttagaatgttcgcttctttgaacacatgaaaaagaagacttttaaatcctcctgaatcagtcccaatgacctgtcaggtctttcatcgtccaagatgggcaccaaggcctaaagaagaaaatagcatctcattttcgcattacggcatgcaggcaacttgctcaggaatgtgaattccacctaaacgtttgtttcatgttttatagaggacttaacactatatgaatccctgagtgtgtcgcacaaccaaaaatctaattctgttctatttgtcatcccctcaatataaattagtgattaaaaatgagaaataagctacaacacaacaaaccagatggtgtcttaccttcctataaacactgttgtgtttagagagtttacacatgtgggggaatgtaatgacttatttttttcacatttggcaatgagtcatgtcatccattttagcacaaactgtcctgaaacttcctcccaaatgaagacatggaacagtttcactaatatgtaaaagcacccatgccagctgcctttgattagtcatgatgcctctctgcccactctacagccctcatctaggagacaacctgatccagtcggacacccaaacagaaccaaaaggtcggcatgtcctgaagtcaacctgctggggaagcagatgcacttttggaggggccaagatgcttcttccctttgcttcccaacacatacccttaaaaattcaacccaggaacttgatttaacagtgtcctcctctttacttttgacactctccccaacctttctgagctatcctatggacctaacatatagaagagaaaccatgaataatctcaggaaagttctaagttcaccaattattaaaggagccagagtctatcccaactgccaacattcaatggatgtccactctgtggaactaaatgggaaggaaacaagaccagcctgaaatgcaaaccatgtttgacaaaactgtgtttcattattttacactgacagtgcttagggctatgcctgacacatggtaaacccctagcagggagttagccccgccccttctgcctaccccaacagtggaattgggtttatgtttccccttcatcatctgtcaagacaactcctcccctccctttgtggaattaacagtattaaactgactgctggtgttagtctgctttttggttttggtttgctaagccattgagatagtaacacctctcctcgtggtacctgtgaagtttatttatgaaactaaatccagatctctgtaattcttgctctttagattttatcttattggcttgacttcatcactgaagccattcatcctaacatccctgcctgctggctctctgaaatccaggtggccctgacatccccgtgtgatgttgttgcctctcctctgtgaccgtgacatgtgatgctggcttttctgtttctcccatcaccctccattgtttacttctctgtctcctggtcaagggcaggcatctgtcttagtcagctgacttcacattcccaaggccaggcctaagtaaatgagcatattcaagaacaacagtttggttggtgggaacgtaaattaattcaaccatttggaagacaggtggcgattcctcaaagacctagaggcagaaataccatttgacccagaaatttcattactgagtatatacccaaaggaatataaatcattctgttataaagatacatgtacccgtatgttcactgcagtactactcacaatagcaaagacatggaataaacataaatgcccatcagtgatagactagataaagaaaatgtggtacatgcacatcatggaatactatgcagccattaaaagggacgagatcatgtcctctgcagggacatggatgaggttggaagccattatcctcagcgaactaatgcagaaacagaaaaccaaacaccacatgttctcacttacaagtggtagctgaacaatgagaatgcatggatatatgggggggaacaacataccttgggacctgttgggagcatgggggagggagagcatcaggaagcatagctaatggatgctgggcttaatacctaggcgatgagatgacctgtgcaacaaaccaccatgacacatgtttacctctttaataaacctgcacatcctgcacatgtaccctggaacttaaaataaaagttgaaggaaaaaaaaaaagaacaacagtttgatgaacatttctcatttttatctcagaatgtgtgtaaatattaacaggggcatatccctaaagttagctttaacatcagtcaaaatcacccaaaaatgcaggggaaattaacccgggtggtacctggagatgacctaagcctcacccagatctagaagataccacacacacagaaggtgcctgggtaacgtttggcagatagcagcatgcaggaacccctttcttacaagttgctagagaaaactgcagcttcctcctccagaggctctaggcctaccttgatcccatctttcctcacaataaaattctcttttcaatcctccttaggaggttttctagtctcagaagaagccttcaatgctgttcataggagattaggtccccctgttttagataacaatggctgtccatcctgttcatgctcataaaagctcaactttgcacagacttccctgtgcaaacataccgatgtctcccctcttcctgtccattaagctgagtcccctataccaggatccttctacagacccccttggggcggctgtctccactgcccttgagaaccactctcagcctcagagacatttccagaggagaagggctgctcatgaacacagtcaagtggggagaacgaggccaacccggtggccaatagggaccaagaaggaaaatagcttccccttagaaatataaacattatctttgtaaatgtcatgcttatatggataatccacttagtaagctcacttttcatagatatcaggccagttgctaagtatacattgttccagtatctgaaattaatgatattcagtttaataggagtgttcctctatatagcaattctgcagtcattgattaaaacagtcctcacttttgctgtctggactcccattctccctccataatcataggcttcaggctccttcacccatccaatgacctgaaagcatctcccttgctgctgcctgtcacacctacacccctctccactcacccagctgtcccctctccccagtcagccacagagaaaagtttgaaggagctttcttctcactgcccagttttctattttacagaaggctttagaaaacacatatgtgctctggctaaaataaaagtgaagttataatgtgatctaccacatcaaaaaaaaaaaaaagaaacggaaaatagttttagttaattcagcatcagaaaatcaatatgtccttagcagcattctgtgcttgacttcaaaatgtgtgttttaatcttgactttattacatgttgtacttggttagctcacacttagaattctcatcaactgctttttaggtctgtggatgggaaggtactccataagagaaatcagcctaataattgaatacagagctttaaaaagaaaggcttgtataactctgaaggggacaaaacaatgacgcagaaataaagtcagactacagcagttcaaagacctgtccttgtttgtgattttttttctaatatacagactcaagggttcaactaagaggctgttgtcggttacgcttctcatctatatcctctctcagatcagcagacatctagccactctgctgcatgctaatataaaatctgtctctgtctcctcacacatcccgtcagagaaaccatctaatcatgaaccatcctatcattacagcagccactgtaaatgcttgggaaattaaacaacaaacaagactcctcattcaaatggaaagctggcagcattgttggggagatgacaaaacccatcattagactgggaacaaactgccttgccctatgtgccctttactgcttctctttttcagggtacgctggaagaaggggcatagctatccattattcactgacaatctcataagtcatgccactttcctaactattgtaaaagagccatagtcagaaaagtggggtgaaatgttggtgacagctgcttatctcaaaggcttctaaggtaaaccaccaaaccataatttgatgcaataatatggtggttattgctattccttgaccaactactcccaatcccttcaggttagatttctcctatttttacattctggagtacacagagttctttcaccagtagctaagaagatgcaaattgatcacaacctccctgaaataaaatgaggagggtaagaaatggcccaggtttcttgattctctctgctgtgaacctggggccatgtcaccttccccgtcttctttcctgcacggctgaggatggcagacagtaactctccttagcagacaaggcaatctacccagcatggaggaaacaacaagtaaggactgaagttctacccgagccacctggtagaagaggaggaaaaaaagatgaaggaaatctgaataattgaaaggcgttagccctacacttaatctgcctgatgttacataataaactctgtcagtagaaacagactcttcctttcacccacttccttcaccttttccaccagatttcttccatttgtcacccctacagctcagaattggccctgccctgtctcctaatgctgaggacagaccattaaaggaaggaaggtcagagaaattacaatgacatggctttgttccccaagaacattcactctggaagctgtcactgctcaaaagacatcttcattctagctcatatggccagagggagcccccttctcctcaattccaatttgctttgacagacacatggctgtgaagcagtggtttgcttcccggagctgaagctgcactggaattccaaagctgccctagccctgtcaacagaagtcagcagcttgaagaagaactgctatccagtcacagccagcgttccctgacacctgataatacacactctctcaggcaagatgcatcccacctcagattattccagccctgcctctaattgctcccaccagggcaaacagggtggcattctgctttggaaggaattattaaggctatgttgaaatgaaagtcaaggtgagcccccgcaaatacagctgcattttttaatccagaccaaacaaaactttcttttagcttctagccacactctcccaaaacaaaattttaaaagaaaaactgagatgcaggtctaaattatataataagaggaaccccagtttccctacccagtttgttactgaagaagctatttattacaaaagctccagagtcactgttctcctccaggtccatgcagaagcaatgaagcccaacgacaataatgccatcaggagggcaggcaaaaagctcgttttaaggctcccaacggggtctaatacatcatccaggaagaaggactactctgagaggtgcctcagagggaaaagcctgtcaaatgactcaatgccaccagactctgatctgccaccagaaatgctgcaaccaccacagatactcactgacatagacagaaaatcctgcttcattatcctaagtctaaacacgtactttatacctgtgggattaaaagtgcaaaaggagtcagatcagtctagatgttatttattttacatagtaattgagattcataaaagaaaaatacagttggacctcattatccagagattacatatttgcaaattcacctgttagctaaagtgtatttgcaacctcagaatcaaaacttgaggcacttcccagccattcatggacatgagcagtgaaaatttgagtctcctgacaacaggcattcccagccgaggtctgacaaggcaatcctatcaccttcttgtttcagctctcatactgaaaataagtgccacatcctctatttcgtgccacattttttgcactcttgtactttttgttggtgatttgtctgtttaaaatggccccaagcatagggctgcagaactggctggtattcctaagtgcaggaaggctgtgatgtgccctatgaagaaaatgcatgtgttagataagccttgttcaggcatcaattatagtgctattgaccatgagttcaatgttaatgaaccaattgcatattaaataagttgtttttaacaaaaaatgcacttgaaacaaggttatttattgatcagttgacaaaaatatggtgaccagaggctcgcaggaaccaaaccctatatttcccctaggagcagtggttcaggatttgctaattcagtatttgcagtgacttcatagagcataattaccacatgctctcaatgataagaagaaaagacgtaaaatatcaaaggacatgagcaacagatataacaccctaacagtcttccccagcctgacacaggatcatcacaggccaacctgaaggactgtgtaagtagagttttttcagttcactcagaagagtaatcagctccacagagggagatccaatggaagctacctactcactcctgaaagcaaagtactagccttcttgcttcaggggagcacagaacttatcttgctaactgaaagctgggagccactggtgcctgactgtctagcactagccaccctgggcggagacctttctgaagtcatcctggagtgaaaaatagactcctcagaaacacaaatctgtaccattgacaggcatcagggacgacaggctggtggccaaggtcacgtgctgaatggaggtaggaggctctggctgtgactcatgggactctttactgctctcattacataatgtgaaccagatcctcatcttctcatcagataatgatctttgttctccagactaaaggggtgattacaatctgaagagctgattgtgtctcattacacttgtgataatatattcctgatgaccaaggctaaccaaggctattaacttgaaccttcaaataccaacagtcacaagttgtccctttgatatattcgcatctgttctgtgttgaattgaaaaaggttttcttgctacaaaatgtgtaaaggagaaaaagttaaaccagtacagaacagccagtgctgtttttttccaatccaggaaagcatcttaattcaattgaatgacttttagtacactgagatcttaacgtaaaaacaaaacaaaacaaaaaagcaaagtgattcataaatgtcacagcataaaaaggtccaaagccctcactttattgcttcctgatagtcttaagcgcttctcctctagcaatgttttcctctgtattataatcttaagaactataaccactaccttttggaatggaattggtttccttttaaaccactttcctctctttatgacgaaaaggaaatttgagtatctttctctacctccatttctacattgtcagttgtcaaaagaaagtgaacaaaaataaaagaactagatgacatgtgttctcagattcagagatgtactaataaagggatacacgtactattttgcaaatcctagaagactaatttctatcatgatcacaaaaaatctaagttggtagtctccaaaaatggattcatgaagaaaatcagaataatttatgagtgacaaatcaaactcaagagttacaaataggattcaggtaccagaattttcattccaccagcataagatggggctttacctgaccctgtccctgtccctgaagctgagtgaactgcagactaacggcacctctgtctgagtttcctgctcagatagcatattgcagtttaatttattttattttattttatttatttattttttttttttttttgagacagaatctcactctgtcacccagactggagtgcagtggcctgatctctgctcactgtaatctccgcctcccaggttcacgccattctcctgccccagcctcccgagtagctgggactgcagtcactcgccaccatgcccagctaatttttttgtatttttagtagagacggggtttcaccatgttagcaaggacagtctcaatctcctgactttgtgatccgcccgcctcggcctcccaaagtgctgggattacaggcatgagccaccgcgcccagccgcatattgcagtttatttctagagaaagcatcaggactaggaagcagtatgtcaacatgaatgggccagaacagagaagggttttaaactgcaatcaagcaatcttatagtaagaaattgtgagaattatttaaaaatgactattccatttgacttttcagccaaaccaggctctaaaattcccccaatctctcagaatattagaagctaaaacaaggacgtgtgtataaataaattaactgagagctttaaaaagatctggtgacaacatgaaaggaaggcttacgacccactaaaattttgaactgaaaagcagagaaatggttgttatttgactaaaacttacagaagacccttcttcttcggggaagcaggagtgagtcagcaggggacacattatggagaatctcaaatgcacaaagcactgagaggagaaagggatgaaaagaatttcaggacaatccagaggaggtgcttaaaaagaatcaagtctctgccaaagacagaaagagccagctctttgtttcagagaggcctgcagctacaggacttagattggggcataaattctaattaaagcaaatctttctagattccctgaagaatttccactcaccagcttcatctgtcagtgtggcttgagccacttgctacacagctcgacccagagctgctctgtccctggccatgccaaggaggaaactgtgtgtggtagccacactctccctacctgggaggtttatcctcttctgcaactggctgcttctgtaaagacaagcgtctgggtgcagatgagcaccaggatttgaccaaggaagaggaaggaggttaggaagcagagaacaaaacacaacaaaacaagaaaattaaaaactctaaccttcaagggatttcaaggagaaaacagaggaaaaaggacaagtagaaaaaaaggaaggcttctttgagcaggcagagcacaattaaggacacctgtgattttaggagctaacaaaaagcagatgtgtcatggcctcagactcccgtcccttcagcccagtcctcatgcagcctaactggaccccaaaccacaaaggggctggaggagaaaagggaggtctaagtcagcccagctgcaataacaaaggcagaaggctggaaccacaaaagcttttaaaaataaacattgtgattcaaggcaaggggggaaaaacagcactgagggaaacttcaagaagcactggctctcagcagacatcattttaaagaaccatttggaaattgccattcaatgaggtgtttaaatgacaacagagaggctgtcttacccaagtagaacaggatcaaacagagagatcagaagtaccctgccctgctcgcacttttctacagagcaactaaacttgcctttcatctctccaggaatactttctccatcatgaacgtaactaaagcctctaagacattgaaagatctggaattttcatactgttataccccctacacattctagatcgagcctagcaaattagcccaaatatgtatctatttcagagcttttaggaaaatagctagtctccctgtttgtactaaccacgtgctgcttctaaattcaatgtctgaatgtgcaaactatggcctagaacttcctaagatacttaaaagaaagaggaaacgtggtaaacctacaacacgcaaactctccttgaagaggacttctcaaaagctcctcagaggagtagaaatcgcaccatgatctaagttcaaaccctgtcaccaatttctacctgtgcagagtggatatgtatttctgttgttttttgttttgtaaaacttctctcagtttcttcttctgtaaaagagaggtaacagcaaccaggttgcaagtaaatgttgaggttccaacaatatgcataccaagttcctcactcaaaattgctcttaacccttcaatattattatcatcataacaaacaaatatttctgacaccaaagggctgatggttaagagtgttggaatggtctactctacgagcctgcatccatgactttacccatctgtgcctccttgcttaatataaaaaataaggtatgttagattaatttctttaaggcccatttgaggactaacaagtctagttgtctgggaatttgaattcttcctctgtattttacaactgtaaggattcatcctattgctattaggaaggtttttttcctccaaacaacttttcaaaaaaagaaaaattaaatacattaatttgatgccttttggggctacatgttttgaaagggtcacaggataagattttgatatgaggtacaaaaggaaagaaaaataattcttgaaaaaccagcatctctcctttttttttttttttttttttttttgagacagagtctcgctctgtcacccaggatggagtgcagtggcgccatctcggctcactgcaagctccgcctcccgggttcatgccattctcctgcctcagcctccccagtagctgggactacagccacccgccaacacgcccagctaattttttgtatttttagtagagacgggatctcaccgttttagccaggatggtctcgatctcctgacctcgtgatccgcccgcctcggcctcccaaagtgctgggattacaggcgtgagccaccgcgcctggcccagcatctctccttttatttaaggatgagacaaagccattatgtatcacaattgtgtaaaggcacaaagagctaatgacaaagggccttctttgttccctagtcatagcagttttgttctaaatcatcaagtctgctacctcctaaaaattgatctgatgaatctttcgctctttctcaagcttttgaaataatgtagaacccataaaccctaaactaagatgaacatttgccaatgacactccttcatcaaactttaagctgctcctcctcataagcacatcagcaacaaggcagttaaggtgattcagatagcaggcactcgcccatacgccacccagcacgccaaggcagcttttggtcagattgcccagcaagccacacaagatggtggcaaactgctctggggctgtgggagagagccaaacacagaagctccaagggtgagggagggaagactctacagaaaaccagggctccatgttcaaagctgagtttgctgtaaaatggagcacaggaaccctgaattgccatgaataacagtgccagctcctcggaacacgtatgagcatcaatttgggaggaacccaatgacaaacgacagatacaagtagttgagaggctcctaggcagggagtcccaacgatgtgcacattttacaatcagatttgtatcaaaggcatcctttaatgcccccagggacaactttcagcttcagttagaataaggtaagctgtgttgtaggaaaactgattcaagtagtcttggaagactcagccaataatttgatctattttcacaagaaaatatgaaccagaatgatttttatcaatgccagtggcaataaatagtgtacataatatgctatacgtagtatataaggttaatagctaatatcaaatctcaactttttaaaaaaagtcccataattacactattttctttaaaaattagaactgtttcctggaaagcctttgagggatcgtaatttaaacagattttaaggcagctaccctgatacctgcttcctcctgttcacactcctgcatgatcccttgagggtaggtgggacctgtgacttgtttctacaaatagaacacagcaaagataatatatatgcatgattaggtcgttatattatataaaattgcagcacccatcttggcagcttccctttctccctggctggcttttggattcaaacagcaatgctggagaaatccatacgacaaggaagtgcaggcagcctctagagctgaaaaagcctccagcaagaaaatgaggccctcagtcctacaaccacaaggaaacaaattctgcctacagcccaagtgaaccctgaagcagatccttccccagctgagcattcagatgagatccaagccccagtcaactgtccttgattgcagcctcggagaaaactgaacaaagccagatctagactcccaatccatagaaatgatgacataatataatgtatgttcttttaagtcactaagtttgttgtaatatttttatgagttaatattagtagataactgataaagatcattaaatctcaagttgttaaatacagagaaagataaataattttatttaaaataaatctatatgattgtttattcaatggaactggtctataataaaatataaatgtatattttaaatgcctgattttattaagcttctttttaattacagcacaaaatcaggcattgcagataactgattccttttccatttacaattctgcagtggttctaaagaaagcaaggtcataatcaaataagagaaataaaataacatcaaaatatcagcatttgatcattagttaccatggagagttcagcttttaaattgacctacaatgattagacagtgccacatcatctactgtcaagatttgttttcaaatttttggtagctcatataaaacacctctgagaatactcagtaggagatttttattctgattttatcaataatacaaatgaagaatctgattgttgaccaggcatcagtaaagtactgtattactaaattgtgtaatgataggagttcatgggttagaacaactgtcagtgagttcacagaaatacatttaatattgtcataaatatagactttaaaaatacgtagaacaaaacagttttaacaaaacagaaaatattcaagaaaagatgcaagtctatttcaacagattaagtatatacccaaaacatgaaacagcctatgcagatactaaagtatttttaaaatcatatttatgaattaatttaaacataattagtataagtatattatttcaatctgtctactattaaagattaaaaaagtaataaaatataatatgctagatgttcaagtagcaaaatctactcactcgaagcaaaacgattttgattacttctctactttttgggaaaacagagaaaaatgattttcagtcttgaaatgtttattaacttgaaactgaaagaaacattccaatttccatttttgaactcccagatattaagggattgctatcttctaaaattaattatccttttaatgatagtatatgacacaatcaaatgaaattatttgctatattaaagccatgtattcccttactaagaagcacctatgataacctatgtcattatgttttgaaatttttcagcttatttattaccttaagacttaaatgtagttaagcaagtatctattttgttatttttatgaagagtaagctgacaatttttccctcaatttgctatcttagatttccctaaaccttgcttagcaagtactctatcacttctcttggtcttaactccaaagatggatgagaaaacttgagtatagacaggctcactgtaatttacatcattcatggaaacgcctctttccttggtcgttggcttttctcaaacatacacttagcatagagatttcctagcatggaaatgatggttaaaagctcatgtgtgaagatcagctaggaaactattgtggcaaagcaggaatatggaaaagctgaataccaggtattatttcagatttggttttgttctcctcaaggtgtcttacagagaatgctcactgaatcttccagggtatcttaaaggcatggaagattataacttaggaaaaagcaaatataatgaccaagagctgacaccaaatggaaatgcttacagcaatagcagtcagctgcctgaaaacctcagcttgcccctgttattactaatggcccaggtaaggcaaagtccttagttagaaactgaaaaatcaattattggctgccaagtactggttgacctgacaatagaatggcatagagaatgatatttttccaagtagaggcccatcatcttctgattttttacagtagaatcaaatgtggggtcaggaacacctgctcagaaacaccaccgtgatatcactccagcacaccttgctacctctcttccctgaaggatgcatctgtaagaagcggtgtaattagagatacttcactgcacaatcatatgtggaggaaacagcaatagtatagtcctgcagagacaactaagtaagagacaggcaacgattcttttatttaaaaaactatgagtatagtctaaatagtttggtgtgtttgcacatatgtatgaacgtactccacagatgcttggcatttatcattctgttacctaggaggggacttccactctgtcctataatctccaagttagcctttctagccagaaaaaatcagggatcaaagagacactgaaactgtggcaacataaaaggcagaaacacaaatgtcttgatcattggcctacatccattgttaggatggtggcactgctatctacaaccttggcttaaagacttcaatcccaagactttctcatactcgagttctagaagtatctctatcccaaacctaaacaaaatgttcaccaagtcttccccaaaattgcctcttacatgagcacactttttaaaagaagacatacacgcagccaaaaagcacatgagaaagatctcaacatcactgatcgttgaagaaatgcaaaccaaaaccacaatgagataccacctcacaccactcagaatggctattattaaaaagtcaaaaaataacagatgctggcgtggttacagagaaaaccaatgcttagacactgttggtgggagtgtaaattagttcagccattgtggaaagcagtgtggtgattccccaaatagctaaaaacagaattaccattcaactcagcaatcccattaattgatacacatacccaaaggaatatatatcattctaccataaagacacacgtgtgtgtatgttcattgcagcactattcacaatagcaaagacatggaatcaacctaaatgcccagcaattttagactggataaagaaaatgtggtagatatatagcatggaatactatgcagccattaaaaaaatcaagatcatgtcctttgcaggaacatggatggagctggaggccattatccttagcaaaccaacacaggaatagaaaaccaaataccgcattttctcacttataagtgggagctaaatagtgagaacacatggacacaaagagaagaataacagatactggggcctatcagagggtgcagagggaaaggagacaggggatctgaaaaaataactaaggagtactaggcttaatacctgggcaatgaaataatctgtacaatgaacccccgtgacataagtttacctatataacaaacccgcacatgtatccctgaacttaaaataaaagttaaaaaaaaaaaaaaagaattttcaagaactccctgggacatgaacaataaaaatgccttttgtggatgcttaaaaaaagaaaaaagaaaagaacaataaggatgcaacttgcatccaagctctgataaaagactcatcttgtgggaaaccatcttaatttatgttgagcaagaaagtcttattggggaaccacctagtctgaagaaaaacagtgaaagcgttctcaagtgcgaagtatggattctgacaacgaattctaaataaaagatcattgaaacaactaaagggagagagggaggttttgtgataaactgcatttgacagagttcctttagatctagaaaaaacaaaaccctccatacacttatggtatctcctaaatattaaagtcttctcgagggaagggcaggaggtcaggacaatatcatgaacaattaagtattattttccaggcaagttagttttttttttatttttctaaactgtcagtggcaatcattctctaaagaaaaggggcctttattctgagcctgagtaaacatagtgaagttgctatagaaataaagaagccaaaatctaaaccataaaaaaactctggtgctaaaaatggatactctcattttgctgcaaaattataggttcagcaggtgctccaagccactgagacctctgctgccaacgtggggctttcctctgtccctaagcagctcactgtcttccaaggaatctaagtcatagaaatggcaaggtgtattgaatattctggtagtagatgctagaccaccaaagttgtttcaaatcaacagctgtaaccatcagacttagcctggaatgtgttctcatctggctctgttgaaaaagtactccacacccccctgaaggtgttttcactgtgtctgcgttgtggctttgggggaacattatctatgttgttactggttgataagctacactctaaaggcgaaatccaaaggagtcttttcaaatctgtgatgctgtattcagattttctaaacctcgacactgttgacatctggggccagataatcctctgtcatgggggagctggtctgtgcatggtgagatcctgagcagcgttcctggtctctacccacaagacaccagcagcagctctccccaccctgaatgacaacaccaaaaatatcattagacattgccaaatgtcccctaggaaacaaagttgcccctgattaaaagccactgtgttagatccatttaatagtataactttcaaatgaggccttgaaaagtatagggtaaatctatttgcttccctatttggaagataaatagttacaggaaaaaaacaggagccagaataatgtctaaactcccatgtcttactaagagtatgcatacatacacacgtttccatcggcttagaaaatttctggaaagaactgttaagaagatgttaatagtgcttgcctctggagagtgaactgtttacactttcctactgtttgaacagtttactcacgtaccccttttcaatcatgttttaaataattttaataacatatttttaagtcacattcaatatattttttagaaagcaataggtgttgattttcagtcaaattagagttaaaatggggttttccaatccatttgaaattccaaagcccccgttgagggagctgggccccaggcttggatgccatctgccggcagcagccccagccctggcatggaagcttgtagaccatcacagcctcctttgagtggaaaacagaataaaatggaagaaagtgccacaaaagcccacaaaggattgctcgctgtgtggtcatcgttctctggaataagatccttagtcctaaagcactcaggtctcttttggagcagatgccagtggcaagtctcacagcggtctgcaggcaccatgaagggaggtctgagttttctgtccagcacgatggtctgcaagcgtgtgcggacctgtggctcgtgtttcctagtaatccccaaaaatgcttccttgaaatgcttctttaaggagccccaactacagtcacctggaacgagctgtaaaactgtgtaacatgaggtcatttcattctggattctggatcctggatccccaacagaatcaataagaaaatgtcaaaatgctgggccccaggcccgctcctgacttgctgaatcaggacctctgggtatgggaacacagtctcattgttaacatgttaccagatgatccctgtgaaactttctgcttatctgtgggtcagtattcaagagtttccgtaattttcaagttgaaataagaatcttatgtaaaatatagtgactttcccaagggctgaaacttgcagattttcccaaaagagactccatgtctcaatcttgaaatggttgggagaaatttatgcatcaaaaaggagcattttaaagacttatcgtgtgccaagatatattaatacagtcagccctccatatccattggttccatatctgtggattcaacaatcagggatggaaagtaattgggataaagaaattccacaagtgctgtaaggcaaaacttgaatctactgtgtgccaaatactatgttgaatccaagcaaatgaaatgatgtataggcattacataggatactacaagtaatccagagatcatttaaagtatatgggaagatgctcacaggttatatggtaacactacaccattttctgtcagagacttgagcatccacagagtttggtatccacaggttcttggaaccaatcccccatggatacagaggatgactttattctccatctatattccactgggctgactgccatgtagttatttcattactttttactgttttgggtccttgggaaaaacaacatgtcatgcccagaatgataaggtgatatctgaacaggttccccaaacacaaagacgagcatgcatggcactgaagtgagagagtgagaagagaacttcagagagacgtccagtgttgctaaccacagaggacccagtggagaattcagagagaaattacaagttaaaccaatgctaattattgaccaagaaggccttaacatttctttctctcgagggtaatgtcaagccagcaaggtctgagagttgggggtgcaagtatctgagtagctgtgcacacagatacctgggtaccaatgtggagatcactgggaaacaggattaaatcagtaggaataagaaaagtccccaggcacaccggggactgttgtggggtgaggggaagggggagggatagcattaggagatatacctaatgctaaatgacgagttactgggtgcagcacaccaacatggcacatgtatacatatgtaacaaacctgcacgttgtgcacatgtaccctaaaactcaaagtataataataataaaatttaaaaaaaaaaaaaaaagaaaagtccccaggcagtgaaggaatcatgcctcacactatcaacatggttgaagaggatgggaaagaagggctattgaagggctactgagcagtgaagttatttatgagatagaattttgtggctattagagagggggtttgaaaaacaaaagggtaaaacttagaatgattctgagatttctagtttgggaaactagattcgtgtatttacagacaaagataaggaaatccaattaccaaaaagtcattaaatgaatacaatctgctcttacattactataaagttattattttccatgtttatcataaatatttcagagctaattatctgggcttggtttcacttgtgtacttggctgatttttctcattcctcctcttcccactcagcattaaataattgggatccactcccaatgagtgtttctgaaatactcttcaaagtcattgccaagggagagattgccttttcggattggtgtgtctcagatttatcacaagagtgggcagatgtgagggaaaaggagaatgagctttggcagtaacaatgcagagaagagttttgttattcttagtgagcatcaaaaggcagaaaggcatcctcataaatcattgtccaaaccaatagccttccccagaaacaaagttttggcccttctcatcttttgagctaaaagaatcagatgccaagaacagggagatgagatgcatgaattgttctttttttttttgagacggagtctcgctctgttgcccaggctggagtgcagtggtgtgatcttggctcactacaacctccacctcctgggttcaagcaattctcctgcctcagcctcctgaatagctgggattacaggcatcaaccactgtgcctggctaatttttgtatttttagtagggaacggggtttcaccatcttggccaggcttgtcttgaactgttgacctcatgatccacccgcctcagcctcccaaagtgctgggattacaaacgtgagccaccgcgcccggctgcatgaactgttctgaggcctgatgagcctttgcttattcccagattagaactccaggcaccttccacttccatgggtgagaacttcagggtatttactggaggactccaaacttctgtttgtccatgccatgttgaggaacacctcagctggccaagtgggtatacctggaaaaagctctttgtttcctggcacagactagaggactgtaagcatgggtggctttccaactggacagaatctggtaaacaagcaccaggagcctctaagccaggatcaagctgaggcaggtagcagcagctctgtgcctggaggtgggagccggggtgggtggaaggtctaggcaggcctaagcccgccctggcccagcgtgggtctggcgtcctgcctgcgggaggctggttccttgtgcagaattactaaatgctacaaataaggaaacactgcagatgaaagttttaaaggtttattagtaataacaccattcggggcactaaaacttcaaagtcctttgactagcagagtctaactaatctttacaacaccccagtgggctaggtaagcaaataaatattattatccctattatgtggagcacagagagctgtaagaggacttgctcagggctacaggaagatcagcgttactcacatcttggtaactaccaagtccagactcagaacagcaggctgccccttactccactgactcatgctgccacaaaaacggcagggagggcccgggaaagagactctcatgattcagaacagaacttgtgacagaagcaggcattgttggtttttttcttgttgcagctttaataacagtaaatgacagtaattttgcccaattagaaatgtctgacttgagatgttaggcagacgccttcattactggaacgtctactgtaggattttgacaaatcttacccagagtgggaccagcttccctagggctcctcctgaatggtgactcctacatactaaggctttccaggttaacctaaaaagtgtaggtttgcgaactaaacagtccttagtgggggttttaatccttcttttaataaattacaatatgtttctaaataaagaaattttagaaaatatgaaatggtaaaaagaaaatggtagtatgtgaactcttcctagtactataagtgatttctggtaacacttgggggtgtgtcctacatttaaactatataaaattcaggctgtctatatttcttcaaatccttgaataccatccaaaaatctgatttaaatggctacatagcaacccgtcaaatggtggcatccatttactcggccaatctccagctacatgatagtttggggtttcgaattactagtatcacaacaccagataaacatcccttttcatgaatatttctattaatttcaaaattttagaagaagagccactgagtaaatggattcatacatatttaaagcatttcatacctaccgtcacattgttctccataatattctatcactttccactttcgtatgttgtaagaggttcatttttctgagcctccaaaatttctatgttggtgaggcttaagagtagcaatggatttttttgttttgttttgttttgttttgtttttgagatgaagtctctctctgtcgcccagactggagagcagtggcacaatctcggctcactgcaacctccgcctcccagattcaagcgattctcctgcctcagcctcctgagtagctgggactacaggcgcccgccaccactcctggctaatctttgtatttttagtagagatggggtttcaccgtattgttcaggctggtcttgaactcctgaccttgtgatccacctgcctcggcctcccaaagtgctgggattacaggcatgagccaccacacccggccagcaatggattttaattaatagctagtgaatttagcataaggtcatgcttaaagcctagattttagttatgcggaatgtttaattggggtagtgagagagggctaccagaaaacagagaaaggtaatgtttacccatctccaaaatagccaccaccttctattaagcaaccataaaaacaactcatgtacaagatttttgcaagcaaggtgtccccatttcacatttgagaaaaatgaggctcaaaaagattcactcactcgctccaggtcattgatcctaggtttggagccaggataccggccctagggcatctgttccatcccactgggatatcaatggaaactaaaagtgctggagaccctgagcagggtagacaagagaatgtttttgttcatgattttttttaatcttcttcttccaaattataaatggcagaaatgtttttgatgctagcttcaaggcaaccttcagcatgcaagaacccccagcaggcttgcattaaaagcattttgtaagaaccttgggtatttggagtacttttacttaaatcttgaggaacacatgtttaagagggcaagctctgagccagacaaatgtggcttttattcctgagtctgcaatttaggatgtgtacaactttgagcaggccccaaatggaaaatccaatcttcatttgtgaaatgaaaaagagggggaattaaaagagacagtacatgcagaagggtaattccaacgtctggacatggtaagtcctcaagaaatggcagcttttaagatgagcatgttagggggggttccactatttcaaacaaggtcacaaagaggtagcataggtttttgacttacaaggagagagaaggtaatctcaactccacaggctggaaactctattcccttgatgttagggtgtgtccccaggttgcacaaagaagtttcagaagtgggaaattccttgttcctatagtgtgtgcttcaaacaaattatgcagcaatactgtacaatgactgagatttggctctggggaaataaacaaaattagattccacaaccaactctgtccaggaagtaccactgcctcttgagtccttaccttcagtaagctccatatgtaaaataaagatcattgaatttccagctcatgtgagaagtgactgagacaacatgacatatgcaaaggtaagggtaacaatgtctatcacataaaacaaaaaactcatacaggaattacagtatccatgagcgctgtccagtcttcctcccacttcttcacctcttcaaagttggccatagtcccaggatttctctggccaatgagatgtaaatagaaggaaaccatgcctcctctggatgaaagccttcccagggtcaatggaccatatgccatgttctcttatttccctaacagtgaccagcaactctcaagatgacagccaccccagaaatcagcctgcctcccaaagacagacctcttcaaagagcacctccagcaagcccagatgcacatggagcacaaatgagaaatgaacatttgttgtttgaagctgcagagatttaggggttgttggttacagcaacctggcccatagaaactgatgcagattttaatatgagtagcttattagtccattccatagagctggaaaaagcgatcctagttattttttatcaaaacattaataataattatgataaggagggctttctcaagtagagtaggtagctgaaaagaaaaacaatgtaatgttgaagacgaaaccctcattcaggaccctctgagaactgactctgctttctgccttggaaaaggtcagggctcactgacatagagtctaatttaggaaccaggagaacccaattcccttcacatccgtatatcacacacctaagtctacaagaacggtaatatgagtgtcctgaggatgaacgagtgatggggtctcaacatgttggggctgatgtctcagttcctacaggacccttcttgggagtgtccctgaaatactgcctaactgggtatctgaagaggaacgaggcaaaggaaagctgcccagagatagcctaaaattgccttccagaggtttctgtattctaattgtattctgtattctaattctctaattgagtgagttaattagagagagaatggtgtggcccttcctaccaatacataatccaccagaaagactggaagtttttcagtaccagcataagtaaggataggaatgcttgatttaagactagaaataacttacgacaattaaaaaaacatttttagcaaagtaacccgtccgattagaaactggtttgttagaaacagtagcaaagagagtttttaaatatccaaactatgcatcctaaataagtttataagtcaatgtttgttaagttgagtaactgttgctattaacaatctttgcaaccaataagtctgcatgtaccccttttaacaagattcattaaatacctagctaaacgatacagctaaacgatacaagcaaactcattgttcaaatttaaatgcaaactcattgctcaaaattaaatgctctgtggtatgcttttattcccaatttttcttgaaggaagaatgcagaaaagtagaaaaagtaacaacctgctcctcttagaaaaatgattgaatgctttatacagtgtaagatctataatgcaaattattaagaatctggctacatttttttattatactttaagttttagggtacatgtgcacaacgtgcaggtttgttacatatgtatacatgtgccatgttggtgtgctgcacccattaactcttcatttaacattagaaaaaagctattgactattgactcattgcttctatctctcaaatacacacaaccaatcatgttttctgacagcatgcatcctctgggaaatatttcctccacctcttctctaaaacttggcagtgtgaggttttgctttgcctttggtttttcttctatctgcctcatgacacttttgagcataagaaagacatcatctagtgccctggaagatgctttgttttgattcttgttcttttatggcaccctctgatagcattacctgactttggaaatcaattctgtgctgtgagaataaggtttgaaatgaaaacttcctgccttgtgttgaaaggacagagttagttttattgaggctagaaagtatttttccctgtattgttctatagacacagaaacaatccttagctcagtctggggcaaaagccaaagaaattgtctaaaatggcagatcctgaaggaggcttgggggttgggaggtgatgaggaagcagtcaagaaaactgtataataataattttgttcacttccagatagtctcctaatgttttcatagatctacttttcttcattgtgcaagctgcatatgtccactgtaaaagttttagaaaaatgtaataaaagaaagggaaaaaagcattcactatctgagtatctacagataatcatcactatcattttgatgcatttctttctaatctttattcaaaattattagaagtatatataaaaatatataaaatacatatacttatatagaattagtatttattgaataagttatgtataggatatatttctctgcatataaagtgaaatcctttaaaagcagaattttaacaactgcataatattcatgtcatgtacgtagcattattcatttcatcatttccttaccggtggccatttctttgccccatattttaagttgttcattcttttttctgtattttgtttatttacatatgtaccctaaaacttaaagtataataataacaaaataaaatatatatatatatatataatgcccacaaaataaaggaactaagtcataaatatgcatatgatttacataaaggagctaaaataagaaaaaaaaaaagaatgataaaagtcagcagggaaaagaactaccaaatcacctagtcaagtaaatgatttacaataacaaaaacaaacttaaaaactctacttgtaacaattttactggtgactaatacttctttaattaataaaacctattggctgcatatggcaatcagtggtaaaaaaaaaaaaaaaaaaaaagactaccaaccaaccaataagcccatgtagaccctggttctgtgaccctggttctgactctccaggaacagccaccggggatcaggctaccaagacgaaggcagagagcaggcagggtatgtagattttaccccaaaattcaggccaaacctagggctcaatatattcactggggagaggaataaggaaggagagagaggaggaaagaaggagggaaggagctgaagaggaggggctggggaggagtaaaggagaagagaaagaaacaggctcagggatatgggcttagggaacgtggtgtgcatggccatgggtggactggcagaagggcttctggaaaaactcagccctgtaaactggcagagaagggcacacatgcatcagcacgaggataccaggcatgaatatccaagtgctgcagaagccatgtgttctcatgagctggagggaggggagcagatgagcagcacagcagtccaaatgctgaaagagcagagctgtgaatcagtgatcaaaagacagggtgaccacatggagtccaaagatgctggtgagaagcaagatcatacaacagataggaatggaatgcccactccacaacatatggggcatgtaagatacatcatggacgtctacccacaaaaagcgatgtcaaatgagttttttttaaatattagaaagacggtgaagagtataataaaggaggggctaataaaaggcaaggatgctgacagaaagaagtcctctccaaggtgaagaattccgtccgtcagagctgatgatcagattgatcagtgagagaaaggatcttacgtggagtccgagcatcccaaagaaggccactcccgtacacccagctgaggccaggtgcaaatgtgatgtgtggggtgggggtgtgcctgaagccaaggctaacccaaaacatctgctggcttaaagggattctgggggagggctcagacacacatggggaaaccagctgtgagaggcatgaatcaaagaacagagccttcccaccaggaaacaggagtctggcttgaaaaagacgcaagagtaaataggcacatgtgagaagcatgcttaaaaaaaaaaaaatagggcattctggtatttcatctgaaagagtctacacatgttttaaagatttatccattcactaagaaattgcaagagaaacacccaccacgtgcaaggcacagcggcatgcatctttttctagctcaaagtgaattgaatgtgcccgtgattgcagaatcatttccattgtcagagtagaaatggctgcttccactctgtatggtggtaactcagtgaaacttactgccacctacatggccccatgtcatccagctctacccacctctcctgcctcaccccctcgcccgagacactctggccataccagcttacaccagccaaccctcaagggacattggtttctgaaacaggtgagccttttcctgcctctgggacttcacgtgttggaacccacctccattcttgtacttttggttccttcttattcttcatgtttgcttttatttacttatttatttagaaaccgagcctcactgtcacccaggctggagtgcagtggcacgatctcagctcactgcaacctccaccttccaggttcaagtgattgtcctgcctcagcctcccgactagctggggttatagacatgcaccacctactttcgtatttttaggagagactgagtttcgccatgttggccaggctggtctcgaactcctgacctcaggtgatctgcccgccttggcctcccaaagtgctgggattacaggtgtgagccaccacacctgctctacatctgcttttaaatgtcatggcctcacagaggcctttgtggtccaccgtgtcaaaatcttcaccatgcctattctcccatcaccctcatctcaagtttaattatgtaccacagtctttgttttcttatttgttgtctattgccttggttagattttccaaagaaaggaccgtgtccttcttagtcatgggtgtctgtcaagtagtggaggctctgtgaatacattctctaattttgagcaggtcaaagcaggacaaacacagaatgtttaatgaaaaggcagcctttaaagtaacatttattttccatttcataaaagttttcaaatgattttacaaatatgcaagaaaaattcatctgcataatacctagtggcattatctatattataacctaattgtcctgagcaacaaagtaactaaggaccccaaaatgaaaaataaagttgatttagccagttggtattgttaaaagtttgactggaagctactctatagcaggaaaaaagagtctcattcatatttgtattatcagtgccaagcaaagaacctggcaattaataagtgctccattaatgtgattttgattaaaagtgttcacgttttaaactaacatatggcagttatctttaaaactatagaatgacacaggtggaaagaaaatctcccttccattcccaaacttcaactcattttacagaggtagctaatgagaaaaagtcaatgtatattcttcgaaacatatccatgcattaatgatcaaaaatacctatgcaaggagatattaggctatacatgctgtttaacacctttcttcattcacccttcattcacatataatagatatttccatgtttgcaaaaatagatacatcattctatgtaaaggccgtacattactctgtgctttatttaaccaggtcacttctgtggacatttaaggttttttccacgattaaaaataaaaaaagcaatgaacatctacaattgtgtaattaggtggacataaatacaagataaatccccagaagtggaagcatcagatcaattaatgttgatagaaatttcctaaagcaccaaacagctattatagttacatcaacccttgcacatgttgggggtttactttttttttttaatctttaccaagctaataggtgaaaaatagttgatagtttacatttctttcattctgagtgaagctgaacagcttttcatactgttagctgcctttttggtttcttgataaaagctaaaggagactgatgcctccatgccaggtaccaggagggttatggcaagagcaacaaccctctgaagacaggctggatggagtcatgattcccatccacacagagctcaaaccaccctgggctctgaatctccagcccaattgcctaacgcatctctcaccttacccacacttctgcacactatgccttattattttttaaatgcctattcttcatttcaggtgacatacttttccatcatctttaccacaacatctactaaggcaaaataaaaatacccattgccattagaaaacagcagaactgtaccagatttggtggctcatatctgtcatcccagcagtttgggaggccaaggtaagaggacacatcacctgcggccaggaatttgagactagcctaggcaacatagcaagaccatgtctttacaaaactaaaaaaaaaaaaatagccatgcatggtaatatgatttggctctgtatccctgcccaaatctcatctcgaagtttaatccccatatatcaagggagggaggaacctggtaggagatgattggatcctgggaacagtttccccatgctgttctcatgatataatgatttaaaagtgtgattctttctccttctcattctctctctctctctctctcaccaccatgtaagacgtgcctcttttccccttcatcttctgctgtgactgtaagtttcatgaggcctcaccagccatgcagaactgtgagtaaattaaatctcttttctttataaattaccaaatgtcagatagttctttatagcagtgaaaacaggaatgtaatgtaatacaggaaatcagtaccagaagtgggacattgctataaatgtacctaaaaatgtggaagcaacctttgaactgcgtaatgggcagaggttggaatagtctggagggctcagaagacaggaagatgggggaaagtttggaacttcctagagacttgttgaatgattttgaccaaaatgctgatagtgatgttgataatcaagtccaggctgaggtgctctcagatggagatgaggaacttattaggaattggagcaaaggtcactcttgctatgctttagcaaagagactggtggcattgtgcccctgctctagggacctggggaactttgaactcgagagagatgatttagggtatctgtcagaagaaagttctaagcaacaaattactcaagatgtgacctgggtgctcctaacagcatatagtcatatgtgttcacaaagagatgatctaaaattggaacttatatttaaaagggaagcagaacataaaagattggaaaatttgcagtctgaccatgcagtagaaaagaaaaaaacatttcatagggagaaattcaagccagctgcagaaatttgcataagcaacaatggggaaaacgtctccaaggcatttcaaagatctacatggcaggccctcctatcacaggcctggaggcccatgagggaccttcctgggcccagggtccctgtgctctgtgcagccttgggacatgatgcgctgtatcccagccactccagctacagacatgactataggggccaaggtacagcttgggctattgcttcagaaggtagcttccttctgccaagaagacttggcagcttccacgtggtgttcagccttcaggtgcacagaaaacaagagttgagctttgagaacctccgcatgtatttcagaggatgtatggaaacacctggatgtcgaggcataagtcagctgcaggggcagagccctcatggagaacctctactcaggcaatgcagaggggcagtgtggggttggaggccccatacagaatccccgctgggcattgcctagtagagctgtgagaagagggccaccattctccagaccccagaatggtagatccaatgacagcttgcactgtgcacctggaaaagctgcaagaactcaatgtcagctggtgaatgcagctacaggggctgtaccctgcagaaccacagggtcaaggctgcccaagggcttgagagtccaccccttgcatcagtgtgccctggatgtgagacatggagtcaaaggagattattttggagctttaagatttaatggctttccttctcagttttggacttgcatgggccctgtagcccttggttttggccaagttctcccttttggaatgggagcatttactcgatgcctgtactcccattgtatcttggaagtaactaaattgcttttgattttacaggctcataggtggaagagacttcccttgtctcaaatgagactttggacttatacttttgagttaatactggaatgagttaagactttgaggagaggcataattgtgttttgaaaagtgagaaagacatgagatttaggaggggccagggtgggatgatatggcttggctctgtgtccccacccaaatctcatctcgaattgtaatccccacatgttgagggaggaacctggtgagagggattgaatcattggggtagtttcccccattgtattctcatgatagtgagttctcacaagatctgatggcataagtgtggcatttgtctctctttcctgccacctacatgtacgacgtgcctcacttccccttcaccttccaccatgattgtaaatttcctgagtccccctccagccattcagaactgtgagccaagtaaatctcttttatttatcaattacccagtctcagatagtttttttaatagcagtatgaaaacagactaatctacatggtgacacatggctgtattagtctagctactcaggaggctgaagcaggaggatcacttgagcctaggagtttgaggtcagtgagctatgattgtgctatggcacttcagcctgggtaacctagtgtgaccatgtctatgaaaaaaaaaaaaacttaataaagaaaaaagcagaacctttctacaataagcgatggcgggatagtgggcaaagcaaagccttggacgtgggctctgcagcttataagtgttccatctggagtgtcggagcgtcagcttcctcatctgtaacatctaccctgtaggaatgttgtgtgggtagaaagaatgtatgtacagtgccctggacttaatacaatccagaaacggaagtggttattattggcaacatgatgtgggtaagatttgtggtaaggaataaaatcttcttcgggtattaattctcccttcataccaggatttcagaacaagggaaatctttgctatttccccatcaagaatcatgtatacaacctgttcgctggagaggcaccttgggctggcaggtactccggagatggccactccctcactagcatcaccagagggtgatgataagagaaggctacagggagaggaggttgatgatcacacacatcacctctaaggtggtggaggtaattcatcagtataacaggcactcacaaaatacttcttgaaagaatgaatgaactgcccacctaagaaatcctctgataaatgttcttttttttctcctcgtttaaaccaagagtactccaccacagcattgctgacctttgggaccagattattctctgttgctgggggctgccctgtgcactgtaggacattcaccagcatccttggcctctgcacattcgacacgaatagcacacacacaagggcaagttgtgacaactaaaccatctctagacattgccagatgtcccctgagggcaaaatcacttccagtaaaaaccaatggttcagactataggaaagcaaaaaaatatatttttgaggctaaaaataacttaactttttactatgtccctgaatccaaagctgttttgaaggcttagcaaataatatagctataacttagcatagcaagtccttagagcaatttacaactgactggagaatattaaccgcctaaggcaaatcagtccttaactgctgctattctgggggtggggagggggacacagcattaataattcaataaaggaaaggctgcaggcaatgagaccctagagttatttatttagccaattagattcgtttttggtggcaaccctgcctttgtgagtatgaatacgccatgtctattcttcaattaaccaggaaaattgtacctcacaaatctgctcttactgcctttcagctggaggatgtgcagttcaagtggtcctggagccttcagaggagggaaacaggctgggaacattcatcacttacacgtgtgcctcacacagaacagatccatgcactgggggtgtgcaaattagaggtgtcagcatcagtcctcactgttcctgccctaactttccagccctaatccagagcaagacagggatgaattatatcaggtaaaatttagagccatggacacatagatatgctcagtttattactgttagtgataaacaatcctactttaaccactaagagactagaaaacatggttttttgtttttttggttttttggtttttttgagatagagtctcattctgttgcccaggttggagtgcagtggcatgatcttggctcactgcaacctctgccacccaagttcaagcgattctcctgcctcagcctcctgagtagcggggattacaggtgcataactaccacgcccagctaatttttgtatttttagtagagatggagtttcaccatgttggccaggctggtcttgaactcctgacctgaagtgatctgcccactttggcctccaaagtgctgggattataggcatgagccaccatgcccggcccaaaacatagtattaaatatacgtctggtgaagcaaatccaagagctttcctgttttaactttgctcacaatttaggctgcaggaactgctggaggtccctgaagtggacctattttggtggcttattttggtctagatcacaatgtggaaggtgtccctatcactctcttgtggtcaataggaggtcaactcaaagccctacagactacagtagctaatggggattatttttttaaaatcatcaggaagaagaatatataaaccaacatagtcctgttcactgggacaaaccattagaaattctagagatttctccataagctgttagagattttctttttccttgggtatttataaccttagcacttccatttctaccatatattttacttccttttccctttcttgctctcctttttcttttttggttccacttatttgtttagagcccagattctctaataattacaggtggcggcaagctgtgaggcttcacaaaaagtcagatacttagaccaggaaatcacagaaaggccactgacaagattccaatgtgaagatgcccctgaccattgacttgtcctcgatatctaaacaaagagcacatccctaacagggggaccaagatttcttatgcacacacacatctgtctgtcgcaggccttggagacctgggatcagtcagatccccaatgagagcacaaaatggaaatcacatctccaaaccacttttgtttcactaaaatcaaactgatgtttcagtcaacaaaacataaagagtttcagtgcctcatgaaatttcactgacccaaaaattacttttgtcaacccaaacatagctttcttttctcatttaatgtgatcgcagttgtgctcaccaagtccagttgagtacagagtgggatgcccgtgaatatgccaggagctgagagctgaacagtacctgacatttcacccatttaaattatagacttttcctactccagaagattcaggacatctatagcatgtgtccaaatgtggcacaaaggaaaaatatcttattaactcagcacaattatggggtctgagatcagaggaactggaggccttgtaatgtagagcagcagcttacaggaatggaactcagagcaaataaattttgattgagacaggaagaaaaaggaaaaacacaagacattacctagagtgagcatacctaaaggccaagattctgggtgagtggaaggtgggaggaaaaacagcccctctcaggcatacaataacaggtgatgtggataccactcactggaagggaactggggatgcccagtggtgtgccagccaatgtttaatgaccacccatcggaagaagcccttacctgtggtgtgtgccaatttccatggtgtaaacactcccaccatagcctacattaagctactatcacaatgtcactgaacacagagacagggagacacgcacacaattggctctcacaaggtaggaggaacagctccagcacagagcacccctggcacaggaagtggaactgaaaagaagctgggcaggggcctggtgcccacttcttttgacaggcgatttgtgtgtatggggcttctgtcttgacacagctggactttcctgatcatttagtctcagaaactgaatggagattgtttcctttgtcactcccaattctgctctgtgaaattcttaggaatttaaaaattcatgatgagcacatagtaacttaaattcaaacatcaaaggactgctcagttttttctcctgttgtgaccttattgtggtaaatattgcattaaattgccatgccaataattgagattcagaagcactttagttttgaagaaatttgctgttcatggcatttagtgacaaagattttcaccttctcattccctatctctcttcattctccttctaccactccctctctctcattttctctcccataatgttctgtctttggggctgtctccaaccctttcccatttatctttccaagtatctctatatatctctttctcaacttctttccccttaccccctctccctcactcttctctcaacttctcagtaagggaaagatttctcgtcctatctgcataatgtgtctgacaattccagtctctgtttgctaatcatgcttaaaagaatgacataccagaatgtagagacaacaggaagaggtaaactaagggaagcactgaaaaataccaggcataacaaaagcctgaacaagctctgcatgcataaagaggtactatgcattaggcatatggacttcacttgagattatgtaccataaacaagtacaacatgacaaaaaagaacatacagacgtggagtaaactactgaccacttaaagctggctgaaaatcccacaatacggatcctgagttttacttcccttttcttctctggttccccttaccctggtacctgccaaccgagcctttgatttaaacatttttatatatcaaaagatacagaagaaaaaagtaatttagatgtaaacattgaaacagcttatgttacaaaatgagtgcagttttaaaaaataaatacgcaaagccttggggggaggagaaaaaaacagctttgaagggaatagacaaataaaaagcccactaaagacacagatcattccagaggtgattccttctttctgcctgacacaggctgtgtggccaacatatgtatcaacagacaggaagtaacagaactccaaaccagacaggcgctgggagctcattctatattcacagaatcatattcgggaaggcagggtcccaggaagtactaaatcaaatcctgccacttcacaataacaaggaaaggataaaatgaattcttgatagccacagatttttcagaggaaaaaagaacagattttcaacttgaaaccattacattttagacaactttttaaaaagcttgaatttcaaggattagggcaaagtacgtgctctgtgttcctctgctaactgaaactgaaggctgtgttcccagttcttacagtcatttgacaaatacatcaacaagaattagccaccaacatgatttccttggcctcccacagtcagaataataaaaagaaattccttccatgatctctttattttaacacaccggttgttatttagtgtatcatcaggaggctgtaggcaaatcgctggctggctgtcacagtcaacatcaacccctttgaagtcaatgacactaaatggaaacactagaagtgccattaatgagcatgttttaataatgctactgaagtcttttacatttcaagaaaagtaccagaaataactctgtagagtttatggtagcacgattgaagtgttgctaatcattatatatcggtttattaatcattataaatgccatcacagttaaatgttatttggattgttcatatgcttaacattgaaggtgtaattaagaaatggcctgattgataccaggcgagtcggtctcagttgaactaggatttcattgaatgtagtcctcagggtggatggtattgaatggatccacagcactggggttctatggaggttcttgcatcaacatcccaaaagttcgggtccttctctcctcctccacaccctccattacacaagtgccccagagtcagcgtagtatctatccaacagacacccatgagtggggctgcatatataacaaataaagatactggatgtggacctgaatttgaatttcagagaaacatcgagtatttttgttagattaaatacaaatttaagataaacagaagatatataatttgttagtaaagctacagttcagacttagactaatgtaattattcattgtttatctgaagtttaaatttaactaagcgccctgtattttatctggcaactctacccaggggaaacatgtgtggagccttttatggtctagagatctgcctctaggtgggaccatgatggccatctgagcatatgtacctgtccttctcccacccccaggccctggaaattaaaaaaaaaaaatagatgtgtttaacgagaaatttcacaaaactgacagaagacaaggagaaggtgtcatgtgggtcagaaaccttgagaaattcctgaaagacagaaagaaacctggctcatcttaacagaggaaattgcagcctcagaaatgaactaaaaaggttgctggaaaatgttgtagtatgtctagggatgccccgagctcagagacaacaaatgcaatgagcaaacgaaacagaagctatagagattaattgggggagcatgttcagaagtgctgaacaaagagtgcctgctgctccaccctgtgtcaagcagcaggagcatagtctgtctagatagagccaccagggtgaccgcttgggctatagaggcagagaggtgccccgaatgactgttgataattgggtgcaccagaaaatgagaacctgctatacaccaacatcctcaatgatctccaattatatggaaagcaaaatggaatccacagataggagatcacagactctcaagatgaccaaaattattagaaaaaccaacatcaaaataaagaggcattgaagagcagacacatgcagaaacagggttaaagtagcaactattaggctttaaaagtagtgtaattaatatctttaaatatttaagatatcatctaatataaatgaaaaagaacaggctgcaatggggaaagcatattttagaaataaaaaataggattatttgtaatttcaaaaatataaaactccttggggaccaacccaaatgtccatcaatgcagactagataaagaaaatgtggtacatctacaccatggaatactatgcagccataaaaaggaatgagatcatgtcgtcttcagggacatggatgaaattgaaagccatcatcctcaacaaacaaacacaggaacagaaaacgcaacaccacatgttcttactcataagtgggaggtgaacaatgagaacacatggacacagggagggggaacaacacacacaggcacctgttgagtggggtggattgtgagggggagggagagtgtcaggagaaatagctaatgcatgtggagcttaaaacctagatgatgggttgataggtgcagcaaactgccatggcacatgtatacctatgtaacgaacctgcacgttctgcacatgcatcctggaacctaaagtaaaatcaaaaataaataaacaaataaatagataaatacaactccctgggttaaattgcaaagttaacacagctaaacatcaaatcaattaactggaagatggcattgagacaaggagacagtcaagagagatgtgtaagctccagaacccactgaatgaaagttctagaggggaagaacaaagatcatcgatgggaggaaatactcacataaaaaaaaagaagaaacagaaatagaaatgcatggaaaaaaatggactcctcagactataataagacagaatgcaagaagaaaccttacatataaagtgatgaaattctgtaacagatgatgagaaaatctgaaaagctgtctaaaaagggggccagaggtagaaaactttacctatgataatctgcttctcctcacagttctgaatggccacactgaatgctaaaagacaatagagtcatcttttcaaattttcaaaagaaaaattgttgtgattttgaaattagcaccctctactccacaaacttgtgttcagctgggagatttctagatatgcaaaaattcatagtttgccaaccatagattgtctctgaaaaaaaaaaactagtagaaaatgcatacaaacaaaacaaaacactatcacaagttatgggaagaaaagtaacatacactataaagtaagaaagatacactggtaagtacaagaaccaataaaactttcatttaagcctaagtaactgttaattggaaatcaaaaaattaataacaatctggaactaaaacccctggaaaataagaagttcacattaattatggtcttacgtggcagcaggcattattctaaactctttttgtgtgttagctcacttaatcttcacaataaccctaaaaagcatttactactattatcattttatagatttggaaactgaaggccagggagttaaaaccttggccaaaggtcacagaggtaggaagggatgggtttgagcaggacaccaaccatgggaatcggctccagagactccaggcaacccataagctcaggcgtcaaggctgaagggtggaggtttgggggaaagatggaaagcagtgaaatggggagaggaaggttcttgtttgattgttggttagaattccataataattccatatgtggaggaagaggatatagttcactctactttaaagagttaagtgaaagtgttaagtgtgatctctaacacagaaatagaacatacaatttccaaaatgataggacacccctccactcactccagtctttttttatattgcttagtagaattttatgtcttgtccatatggttgccacatattcttttaatttttaggtattctgtatttttcctgtcattgtgaatggatcacattatgttgttatatatgaatgagcaattgttagtaaatagaaaattaactttcgcacatttattgtgtaactcatacccctactgaactcttatttttctaatacttataattggtcatcttgtgtttggggggccaaaaatgtggactaattttatattttccacttcaacatgcaaaatttttctatccttttttatccagctgtattgcatagaacttccctaaagcattaaatcatacggggatagctgacctcatcatttcaccacctttaaggggaagaagctggttaccccatagggtagtttatgttctgtgtctataggtactgaaggagctgttgaacattctactaaacgcttgcctgtgaggctattcagtccccactttggcttctcgagtttcaggctgaattactggctctttcctccttccttggacatgtaaaattggtctagattggcatgtccacctacacatgaacccagatgaagtctcagaggaaccacactcctagatctcaccactggacattttacatcttgcgtgatgtttaagagacacttataagatgactccagatgcaaaatatgctgcctttcacatgtaagcttcttgtgaaagaactctggacattaattttgaactatcatattctaccatcattctgtcctattatcagcctgaaagcatgttattcattatggccctcaggtcaggaaaatcaatgactaatctcaactctgtatctattgaacattgatagctgcatgggtcatatgtctgacataagactttgtcctcaagttaatcaattcctacactgatgcggcctatgctctctcacgcagcccttgtgtgttcccagatgacacgtatttatttacaacatttacttgttatattctagaataaaattttcccatttggagtcttttctgaaaacaaaagggcattaggtctaggacaaatccaccataaggttcaaagattttggaaagaagaatgttagaaatctatgtatgaagttctttctgaatcgagcatattttaatatggactattttcctgtgttcttttgcattttaagtcaacaccatcttcttctcaaaagcatcttttgacatgttcaatggttggttggtttgattggtttcatttctggctatttactttgtggttacctccagagagaaatcacttaacattttcatgagtatcaggcctctgaataacgtgaaatcttgggcagggctcatgtaccattttctcaagggctttcccaatactcagtcaggcaggttgacacatacaaccattacatccaaaaagcatccttcagcagctttggcccaaataaaagaaacagaattgagctaacaatgagttcctttacttctaatgaaaattgctcaacaaagaaccaaatgttagcatatatatatatatatacctgctctcagaatgcttactaaatggcaggtgcggtgttaggcttggggtataagggtttccttccatctaattaaaattatgcaaaagggaacaaaatgtcagcctttccataaaacgcatacctttggaatctctcttaggaaacaggccctgtgtctggctagaaatgtaaggtgggaaggagggccagggcacccacagggatggcggtaaatgtattttgccacaagtaaatggattgtgccagatgttgtgggttacacggccaatatgtctgatctataatattcactttaagtataagaaattttgagaaaaccactcttcaaatagcatgatcaaaatgattcaaatagaatatttttaagtgaagtaggtatttaacacttaagaaacaaaagtgtttttgaaaaagggcttggaggctacgagtggctctaaatgggaatagctgatataaattgtcagtggatagattatttctaacatcatccattccaataacagtgcaaatttctatctagtaagttactcaagtgagtatctgctttaagtacactgacttcaagtaccactcaaaatttctaatctttggctatgtgatgtcaaactttctttgctactaaatgatctcacatgcctctagctccatgctgctgttgatgttttcttcttgctatgtgattttgcagaagacatggaagttggcaggctagctgaaatgaatactccagaaactcataattagagaagaaaatgattcttatctactccccaaacatactgaattccttggtgaggctatgcaggtaagataataaaaaatacataaaatgtctgagcaaatttcatcaaaataaaagcatttaacaaataagattgtcaactttcttctgctcatttgactaaaaatttaaaaaaatagcaatggatacaatttgagaatactaaaacaggcccaatatgaattcactaaaggcctaacacagcagaggagaaaaccaaaggcaaacataatatatcttatttaaactgacacaagctttgttttgacacaacctatggttacattgtagtttttggagactgtaaatcagatgtttaggactgagaaagaagaaaatagaagatcattttcttctttcataggatccattatttttctccgtatttgaaaaaaaaattttaataattattacactaaaattatgctttggctatcaatattttatttcatgagatatcaaaatcatccactaaagcagatgtataataaataaataaatgtattcctctttcagggcaatatccagttgctgtactcaagcaggctggtgtgaagggtcacgtgcagctcttaaaataaatggtctgcaaagctccaacactaatgcctaatcccatatcttgtcctgagtatgtggccctcttcccggggatgccccctgtgactccttggggcaaacctacttagagaggtctaaggaagcctgcccaggggaagagtgtcctggacaatgacctcacacttaggcaagacttaaatctggcttcttttattcaaattatctcagagctggtaagtggcaattggccaatgctcaggctgtccccactgtcacatgtggcctgcctttccactgtgtcttcttctagatatacaaagcagttacagcaggtactgcacctattgctttttgtcagcctcatggagtggctcttatgccacagagttgtccaaacccatgggcaaaaacagataaaatggaagccaggagtctccacccacagagacagggacaagttattctcctcagatgtctatagaatgtggccagcacattgttcgcgatgtcctcaagttcagttttggacagaaacggtcatacttatatgacacacacccatttgcctcagtttcccccactaggagacagtaaaaagattggtggttgccaggggctgaggggagggagggatgaacaggagagcacaggggattttcggggcacgagactggtctgcatgatgttctattggtggatgcatgtcattacacatttgtccaaatccatagaatatacaataccaagagtgaaccctaatgtaaactatgaactctgggtgataatgatgtgccaatgtaggttgatcgattgccccacccccaccagccacacaacccacatcagcactttgaagttattctatatttatatacttagattgcatacacaacctgaagacttgaatggatgcaaatgcaggcaaaacaataaggaggtaacagtttataacaggcaataaatattggcaaatttcctgattaaagtcaggtttagatttctatcatcaacttcagtgttgtctttcatcagatcacctttaaattaccactgccaaaataatattaaagtaaaaagaaaaacaacacaaaaataacaattctttaataataattaagaaaagatgttgtattaccactaacattttacccattcaaaaggggcatgatgccctaatgccttgaaggtaaacctggtagtcctacaatcatgagtggatattcttattcaatatatgcattgtaagaaggaaccacagataaaatcaactgacttgccagcagtggtcctcaacttacagacaaacacaacttgccactattctctctcttccttggcaaatctatgaccaatcttcctggattacagatagaagacacacaacagcttttataaagtctatcagttcatttggaaagttcattccttcacccaaaagctatttattaaatgcctgctgtgtatgacacattcttcttggaactgcggacccatcaacaaacaaatcagataagcaatggagctcgtatttggatgaggtaggaaagacaaccaacagcattcaaaagtaaatgttatgagttggaaagtggtaggttccataaaatactataatcacttgttgatgacttcttctgtgccagaaaaacacaaattaccaataaagtgttattgcacctttttccagaaaagaaaactaacgttcagaaagattaagaaccttgctgaaattcacacaaatgggaaagctaatgcagggattccatgtcacatcagagggagtttttctagtcatttcacaattagacccttaagcaatccaaaaatagaccccattagttatctgaatggaggaaaccaggctctatgcatgctgcactctgagcaagaagttaacacattgatcctggacaccagacaacccaacatccatttacctccctgagacccaagctcctcattatcatctccctaatgtttgcaacatgcaattctatttactttccatttttacataaatctttatttagaagaaaatagcataccatggaatattagcctgtgctaaaaagaaatgagctagcaagcaatgaaaagaaatagaggaacctttaatgcatattactacgtgaaagaagccaatctaaaaaggctacatactatgtgattccaaatatatgacattctagaaagggtcagaccatggagacagtaaaaagattggtggttgccaggggctgaggggagggagggatgaacaggagagcacaggggatttttagggcatgagactggtctgcatgacgttctgttggtggatgcatgtcattacacatttgtccaaatctgtagaatatacaacaccaagagtgaaccctaatgtaaactatgaactctgggtgatgatgatgtgccaatgtaggttgatcgattgcaacaaatagaccactctagtggggaatgtcaacaatggaggaggctgtgaatgtaagagggaggtgggataggagaacactctatacttgttgcccaattttgctgttaacctaaaactgctctaaaaataaagcctaacagttcataaatatataaatatatataatataggcctattagttcataaatatataaatatatatacctgtaaatatgtatgtagcagcatctatctatctatctatatatataaaacattatatatatataagcatactgtcatctcatattaatgtttattcaaaaggttgtacaatcctacacttatacatttttttgaaaatggcctctatctttcccacacttgcctagtttgatcactgtgagactcctcaagaatgatgcccggtaaaattaattattaattattaacttatttatttctatggggagaacatcagtacagtatttctgtttataaaacagaattgaaagccatggggcaatggaactaagaagagaaaaatctaattagggcctgacagcctttgataataggattaaagttattttcctcccaactactaatatgtgaagtcaatagtgttgtgttttctcttcttagaaatgtgtggtatgcccctgcaagcaacttttcccatgctataatgtttgtaactcacagaaaataaatatgatttctttgatgcactatcaggaagatgtcagcaaaacatgaagtgacacacaccagcagcctctcagaaccgagctttacagaaatggaaacttttgaaagaatattttctagcagcaagtaacaaagtatctgtttgaatttgtttcttaatatgctcaggttcaatgcaaagaatgtaaggttaccataactttaacaagcagcatctatttccagcatgtgctaaatattgtacctatttttggtaaattttaaaaaatatattttatataaattcttatctggacctgtacttcaaaatgttcttcataaaggctgagcataaaaattcctgtttaatcaaaccaaattaaatcagcaactatccacagagctcttctcccttgtgcaattggtattgtgggcataataataaataaaatttaagatgtaatttaagatcttggcctcaaggtgcctatctctgggggctataggagagacaaacaggacacatcaaagttaattatcttttagctctcaaactcaagacaatcatagaaatagaacatcaaggcagtacaatatccattcaaaaattgagtaggtatatggtgatggacatagatctccttttccttctgaatataatctctttgctttccagatgaatttccacaaatgagaccttaatcagaacagagtctattcaggacacatattgataattatcgaggtcagtggctccccaacgcggctgctcatcaggagggcagatgcttcctaattgacactgctcctagcccccaggccctgatcttctcacttagtaggtcatggatgagtcagcttctgccaaatcccccccttcaatgcccccctgaaccaaactaacatttgtacagcactttagaatttccacaatgtcccttatcctcctaattttttaattctgtgcaaaatcattgttgccatcttttagatgaaaaaacacagattgtataacgtgttcctgttttcagtcagtgaataataaataccatgggttaaatttagatattaggcaagagatgtttccaaaacaagtattttgtgctttagactagcatatatcagtggcatcaaatcacgtacaaaaaattatgctttccaaagtatctggttcaagtgttcaaggttcttcctaagaaataacaaatgcaacctttgacatatttcttttaaaaatttttaactgtccatatatattaaaatatttattctgaaattacaactagaaatttcagtaaaagaatatttgtacctatgtgcacaaaccaacttcaaaaccaaagtaattgtaggatattccaaagtgtttaaattctatttttctttcccctttgaggctgccattattttaggtaaaacaaaaatctgtgttccttctaagccataggacttcgatatcttcagggatacctggcgtccctgtgagtaattacccaggcagtgattaaaccaccaatactaggagtcagcaggcaggctgtgtccacaataggagtttctgaataacaacgtcacacaagagcaaattcaagagctaccgtgaagcccactcaagggaaagcaagcaagtaaatgagttgaaactggaggggagaagctgattgttacaggagttctcttgcccttagcttttacccacccaagcaagacagcttggttctctgtttgcacaaggaccatgtttagaaatagaatctgtgctccatcattaaatatatatttattgaatccctactagtgccaggccctgtagcaagccctcgaatatgaaggaacaagactgagccccactgtaagggagtttacatcattgaataaccagcccctcaacaagactatagtgagacaagcgtacactcagcaggatgcgtccacaggaggatgaagagaaaactggcggggcctccggctcccactagttcttgacagagcaaacccattttctttacatttgaaagtagacagtaatgggtaaataataaatcagactatttgtagtttatccttaattcttccagtttagcaatttgtccctcttatttacttaaactcttaattcagcctgcttaatttttcttcatagtatttgtttttacctgatcgactgaatactcattggtttactcattacccctctgctcccctctcccatccacacacactagaatggaaacttcatgaggacccagatttttgtcactgttgtatccccagcatgctgggtacatagtgggaactcaatatttcttttatttcattattattactattattttgagaggaatctcactgtctgtcacccaggatggagtgcagtggcatgatctcggctcactgtaacctctgcctcctgggttcaagcagttctcctgcctcagcctctcaagtgtctggaattacaagcgtgtgccaccgcacccggctaacttttgtgtttttagtagagatggggtttcaccatgttggccagactggtctcaaactcctgacctcagatgatctgtccacctcggcctcccaaagtgctgggattataggcaagagccaccatgcccagcctcaatatttcttaagtgaacattggaataatgtcaactaatgaagaatgtataattgtataatctgttaaaatgcatttcagatgaagcttaagtgtaatatactaatagaagtttattttataaggaagcactagaaacttccacctagacagtccacagaggccactgaactgtaatgaagcagctatcactaacattagaattacagtgaatatagccaaaagaaatattaccatgtttttttcagatcagaaaatatgtctaattcaacccagctgggatgtggcagggtcaaaatttgaaattcagagttgttggaacttaaggtataaactctgtctgctcggtcaccagcctgcctgccaagtagtcaagaaaaaaatgaccatcctggagtattcaattacctgaggaaggctgggtctccaaagggactgcctcgatttttcacttctacagaatttttagatatacatttccacaatttacagataagtctatgaggatctttttaaagcccataaaaccacacacacaacctgctaccagctaccaggagtgacaaagctccgagtggagcatttgagataatcaccattcatttgtgttttaatatgcatagagagaacaggccttgaaatagccttgcatatgaattcaatatttgtcttttaaactagttaatctggtacagtcttacaaatgcaatgccttattaaagagagtatcacatggtagcatttttctctcccctttagttgagcacattagatacttatagggacatggtatttctctcagaaacacttgggagctagtgaagccacaaagctaaggagataatcagctgatgatcaatgatgagctcccaagagtaaccagcctctatatagtcagcatcactggtttctcaggaaaagcatcaccattgttcatcttgctgcaaaatgtatgcacaagtatctttttatttttaaaaaagccctgacattttatgactgctgcttttctaagatattttcaaatatacagtccatacggttcagacacaatggactggggatagagacggctatagtgccgataatggagaaactagccagagcttcagatatttgttttccaggacatctcaataattgggtacacctcacaatatgtgagacttgacgtcgagtggcacggcatactctggcgcaggcacttgataaagactgtgtttgcaaatacttagcctgcacttcaagataccaggcatctaagcacgtcccagatggtgacagttaatcttcaaaaaaccctatgtggaagtattatcattgtcctcattttacagatgaggaaaaagagacacagggatgtcaatatcttcctcaaggtcacacagcaagtaagtgatggaacagtggctcagccatgaagctattgctgttaaccactaggttgatttgccttcattaatttcttcctaaaactgcacatttcccgttagtccctcttttggtctgtcgtttgactcttggctactgcttagaggaagattcattctattattttctaacttagtaaattatgtgcaactccttggggacatgacacaggcaaagctgtatacagagatgtatgccaagacaccatcccaagttaaccctaacagtctatctgatcctgtatgtaagtgggtatattgtaaatatttttaaattttctgtatactacgatgttttgatagtttaaaaaagccttctggctgggaagagactgcccctccctgggctagtcagttcttaaagatggccatgggcccaacctggagcttacctttgatatgaaaactaactgatgcagagccacacctcctctgtttgggccatatggccccaggaggcactactcctctgtcataaccatcctggggccaggcaccacatttatgataatatatttggaagtatatcattatcataatctgaggtgtctaaatacagcaatgtcaccacgaggggaaaaggactttcattcaccatccatcgaattctttggagataattacaaactttgtaatactttatttcggttcagaaatacaatttagaaattttaatacaaatttctggaagttctgacatttttaaaagataaatttaagcttgttatccttcagcttgctcagactactgtatggatgctacgtggaaggtggttgatcattgagggaccatcattatgaagatgcggggtccacagcgtacatttcccagccgagatatagcagcagggaataaaacagtgggaacagtagatcagcctcatattgcaaatcggcggcacacaccctggagtcgtttgtttcccatgagcacgttgtctaagtactacgataaccaactatgacccagtaaccttgtcatgcctggggccattatgactcaagactgcatacctggaatcaaacttaaactgtgaatatatatggcatgtttagcatgatttgggctgggttaggtgtggaattgttagcctgtgttttcgtctgtatttatttgacatgttctgtgtatatgattaacaattacagaattcactctatcaaacagatatattagttatggcaagctataaggaacgtaatgaaaatgtatgaatgctgcaattatgacaatgccgcaactatgtgtgtaaacgcaaagcagtggatgtaaacataggcagcgaaaggtcctcctcctaccttccatgagaaggaggcttgtgcttttgtggtgccacctggtggaacaagggagatgagagaagagagtcctgaaatggttaactggcccctagagacactcttcacaataatccaagtcctatgctcttaaaacttcacaaacctttatggagcacttgaaaaacaattttttaaggaaaaacatcaaagaatttagtgtcgtgtccttattttctttccacctcacctgactcaatttccccacatgaaaaaatgtcatcaaatgccaaataaagaaaaaagcagagaatggataagaacaaggggtgtatttgctaatgaatgcactccaaaaccacagaaattaacaaggttacaaagcagcctagcttccaatggaacacaaaggatgcctcattgacctagttatttgcatgtttgtcttcttcctccattaaactgcaagctatctgaagtcaaagtaacattatcagtcaataccttacatagagagtacactctataaataaactaatgtatgaacaggaagtttgacaggcagcatctttactcatggtccagaaatggacagttcagttctttagtattttacttctcttttatcgctcaagacaaaggatactacagcaatagcagataaataacaaaaccacaaccccatctatacacagatattgctgttaccttcaaagtgtcccagtctggttgtgtatcattaactttcatccactaataacaaaaaccaaacatcacatggagcacagagcacagaagtgcttccatcatagagtaatatagcaagaagaaaccgaaataagaaggcttggggaaaaaagtctgaagctggttctgccctgaaaaaaaaaaggttttattttacagcaataggttcataaataaatagaaaacaataagaaaatatatgagatctgaagctccattagccagtatccatctgttactcatattttaatatcttctatatcaccctacagcgcaacatatgcaattaagaagaaatggctatgcaactttttggagataagttattgtcaatgggccaaccacacagagccagatgtaaattactaagtcaatttagcaccagtttataaagttttgattaatcctcagctcattttatgttattataatgcattattaaatgcagcgcatggcttgaacttgctccttcataaattcactacatattgatcctgatggtggggcggatgtcatccccatggggcctctgaagtgatattctttccaaatgacaagagagcttctgctcataagacacatgttaagaaatatctggcaaaacagcaaaccttccaacggttttcatcatgttagcttttgacatgtgcatttgtaatgaaagtgcgtcttgtagtaccagcaagacactcattttctcctaactgatccagacatcatcccactccatcctcagggaacccactgagctgatccatgctgatgtcacacaatggcccacactgaggtttgctgaggatagggcactggataaaatacaggacacccagttcaatttgcatttaagataaattatgaataacatcttaatataactatatcacatgcagtatatagggtatacttatactgaaaaatttgctaattctggcaaccccacatgcagagtttcaggttgtggtctgtgcctggctgcggtccacattatatgtgttttaggagaggaatatgtttatgctacaattccaagcacacttgctccctcctgaggctttccctgccttcctggagcttgccaacacacctcttctaatctggcgttgactgtatgagaatctttcatcaatatcttcagaagttaaactgttaattaaatatcaagctaagttaatatcctagtggaagaattaaccatccctgcctttatgaaaaaaatctagatactaatataatggtccctgtgtgaggctagaatttcttacactgattttcttgatatttatgatgatttaatacaaagactatgggaagaatcaacaatattctgaataaaatggcttttatccaattaaaatatacttggataacaaaacaccacagcagtttcatgcaattgtgtcaaaatggttgctaacacaatttaatctctgacctctatttgaaatttcctataacacagaaaactaaagtctatgcttacttgcattcttaaaatgtagaaggctgagataagagaaactaaattgccaatgaattacctttactctaaagataagtgtcaacatatacatatgtgtctacgtgtgtgtgtatttgtgtgtgtgcatgaaatactgtattaagtatacatataaaaacatacacacacatccttctgagttttttcctatgtagagaatacagaaagagcattaagtgggcaaaggaaagcatccaaaagcaatgtcagcaatggaggagttcagaaacatgaagtagatgctgatgttagccatatcccttcccctactcaagagaaggaacgaccagctcccttccctcctcctgctggaatccgggctctgggctgcaggggcagcagctgtttacaccctttaagtactgacatgaagacaaaaactactcgccaaagatgactgagcaaaagagaaaaaagcctgggttccaatcgtcaccccaagagcacccaaggactcaggacacatagctgttacatgacaaaaacacaggtcttggttggctaatgtgccaccaattgggttttcccataggtgcagctactcattttcctgttacaaaatggaaaacccaaaactttccattcatccacccgtagaaaacataacttgctcagtttctagattgttctactgtaattactaagcataagatggaattgaggtatctatatttttttgtggcctagagactatattcaaactgatgaaggctaccacagaaacctaaatggacaaatatttaatcatgagcattctgaattggctcttactctttgtccctaaatatttttttaaataaaaaacaacaatattgaggaagtcactgaaagatccaggttaagaactgaggaaacacaacacattcctgtgttcagcatggttatttctccttgagggtagggtttatttctctgtagcagttaagacagaggatgggtgtaacacgcatagttggaatttaaataaaagcagaagcagccaactatttgcaacatgatgaagttccctatatatttaaggaattatccacagatatatatgaatatcagaggcaccatttggcccagggtgagaatgccaggctgagccaaccatactttaagcacatgtgatttgaagtagctgagacattcatgacaagactgacagtatcccagcaaaaacttaggccagagatagcagagagctggcctggagtcgctttcagctgtgggtatctctaaacatcctgtgtcttgagcttacagagttgcatgggcttcctcaagtgtcagccagcctagtcctgcccaaggaaacatgtgctgagcttgtcacttggtacttggcaggctcgcagagaaaccagagagcgcagtcatagtgggaggcctttagcactgcagtcctcaacttcaaggagaggagcaagcctttgaaatccaccagagacaagatgcctgagaaaacaggggccactctacaactaaataccctttcccaaagggttctaattgggggaaggacagagtgacggagaaggaagaaggaaaggaaagcaaagacaagaagaaaagtgtcaggggtcaacagattttgttccattctttgatttcctggatattttcccaaagggatggtagcacattaaacctggactcaaccagagctacaagttttatttcagtgaaggcattttcttgatcattttgcactgtgtccaaataatgatagcacagggaatacatgaataactgggataaagctgtcagtgaaaggaaacagagcctctggcttctccagtattgaaaatagcataaaagagagagagagagagagacagaatgaatgaattcaaaatacattgtgaaaccactcatccatttgcaggactaggtacgcataagaggggcacttcttcaccccccaggaggaagagacttgtctgactttcttccttaggaacacagaccatgacctaaggcagaactgtgaggttcagcagggaagaggaagctaaaagagccccgagggctccaggcacaggtaacatcttggatgctcatagcaggttgctggggaaagcctgtctgtatctaggaggtggtgtcctagagactatctatttccatgaaaagctcccagtgagttaatttcagagccaaacacaagagcctgggctcacaacatccatgttcactccattaccatgtgctactgagcagattcatccacacgctggagccaaccttgaatggtttcaacttcacatggaatcatctctgtgtattttatgtagcatcctaaagttgcatttaaaattttaaaaataaacacttcaaatgttggacaccttctcatggatgaagatctgcataacagcactgctcttacaatgccatctctctttaaggatagaggagttcattgcccgccacactgggaatattataaaacaacttcttaggatgaaacaaaaattaattttaagtcatagatttatttaaaacccaaagatttggcatcatttaagtcaataaatgtccagagtaatgcctggaacagacaaagtgctaaataaatggcatctggcattcaccattccctctaattataacgaaatacatttcacggctgggcgcggtggctcatgcctgtaatcccagcactttgggaggccgaggcgggcagatcacaaggtcagggatttgagactagcctggccaacatggtgaaaccctgtctctaataaaaatacaaaaattagccaggcatggtggctcatgcctgtaatcccagctactgggaaggctgaggcaggagaatcgcttaaacccaggaggcggaggctgcagtgagccaaggtcacgccactccactccagcctgggacagagcaagactccgtctcaaaaaaaaaaagaaaaaaaaaaaaaaacaaaagaaaagaaaagaaatacatttcactagcatcatattatacattgcaatcttcttgctaatattataaaaccaagaaaaaaagtttatttttacaaatacagtttccacaaaactcaaaaaacctcttttcattaatgtatttaggaaatattcagcttctgttgttttccagaaacttctgcaagctctagagatgcagaagtaagcagggcaaagtcccctttcttgcagaacgtggattcacatcaggagacaggtaataaaccaataagtaccggggtctcaaatgcaacagcaggtaagcacaagtgctgtgaagggcagagcatggtgaggcgcaaggggaatgcttcgtaggacttacacagagtggtcagtagagctgcccctgaagaggaggcatcagcacagaacccttcctaaagaaaagtgagtacatgaggctgaaggacaggtgcaagggaggaatcagtgaatgagggcaaagaaggagctgggagccaaatcatgggagctgggtcaccacaggtcccgagcagagataccacattgacagcaacactgccagcggattataccctgatgtccaatcaatggcaagggccaaagcatcgggttccttttatgttatatcctcatttttcaatctatcaccttctccaaaggcttccattttcctctctgttttcctcacccctgtgcttggtgtaatagatagtatccgatcatcatagcagccttgtaactcatttttaactgaaataaatacttgttacttagtacataatttctcctgatcaaaaattccaacaaagttcagaacactgaagaattgaaattctaatttagttttactatttatcctgcatttgagcagaaaagacaaattctaaaacaaaaaaaaaaaatctagaaatatttagtattcctacaatgataagctgatttcatatcaaggggaccaaggatgtgagtcccagttccctttccctgccctgaatctagcacttatttctagaaggcaaaaggcaaaagcatttcgctttcagtagagagctcatttgggcttggtttttcctgaggaaatccatttagtataattttttaaaaattaaacttcacatgcctatgactcaaactttcaaaccacccccacactccatcagttattttcaataattaacagtgggtgatctcagatacagcctggatgttttggaaaacaggaaatagtctgctagattgtagcctcatattccccttggaaggcttcttgattgaatgctacaagttgtcaaaccagactggttcatttgactcccctgaagcgcttgcaggagagttacttagtctctctcttccagaaaggagagcagccagaatgccagaacccaaacatagtcaccccaggactctggtgaaggagaaccttgcaggtggctcccaaaacacctctgctggcagcttttcccaagaggaaggccaaatggccgaagctaagtcaatgatttatttctaactgctgctaggaggtatcgtgcagggttatggataagtaccatgacttttctttgttgtctttgactttctggcttacaatttctgtgatcaataggaatagtctcaaagtgagcaatcagaaatttgtcctggtagattaactgtcatgcaagctgcaaaacagagccagatgaaaaatgcagaaactaaaaccataaagaatgagttgagatatcaagagaaatggcactggactactggtggtcctcaacctcatgtgaaactttcaagtataattaaagtaacacatccaccagaataatttacattattgataaaagaatagaaaggattagataatttaggcttctttttagaatcattagaagactgagcaatagacaaaggccaatttagttgcaaaagttttaattttattttagctataatggggacactcttttagcaggctatgtaaattgctttaaattcaagccattggtgaggagttgctaaagttgcccgatttcttagtttgtttatatctgcatttagctgctatgcaatgtattaatacatgaagatctaataagatattaaacagctctaatgttcagggtgactcccaaattatttttgaaaaattaatataatgggtcatattagaaacctttcattttgggctgcaagtaactatccagacagtcttacaaggttcagtgcttagagagactgccgacaagagatcccatttaaagcggaggccatgcttaatgaacaacgaaatatggccccatggggtagggttgaaagggaaggtcctaggtctcttgtatgctcaaaataaggtctaagatggcttatggggtccaaaatctcagtatggcttcaatgcatcccttacaaattgtgggcaaaaattgcaaatggacatgttaagaaggtgatgaaatttatcaaaacaaattatttgaaagccaaggccaatagggagcttccagagcagcacctccagtcatcaggtcacagaacacaatcaacaccaattcccatgggttcactttcatgctgaaatcatgcctccccctctatgtgctatccgaggatcactgtgtttcctacagggagctctttcctgtaacctcccagactcatgagcttgtgctgagataacttttaaaattgaatacttactgagtatttattgaaagctggtttcttttaagtttgctacaaccaatacaaaaatcaaatgggcatcaattccttgtagagcaatgtttactcttgttagaaaggaggtgccattagtaagataacataggtattattttactagaaataaaataattgtaataaatgacatgggtgtgtttcattgcaattaggtttaatcatgttttctcactgtaataaagaagcacctgagtcgacatggaaggcgtgattgagttttcaccattgccctaaaatagtgggtgtgtatctccattatcttcaagtcactttcaggttaaaaccatcccagagtatttggtgcagatttacatgttaactagttcctcagagagaggggatgtgagcagtcttaaagaatatgccatctggtgcagtacgacttcccggtaacagtttatctaaatgtcatcattttgtttttcccacacatgccttaatcaccttcttcaggaataaattgactctcttgtcatatatgcttttccatggtttctacacagtacagctctaaatgcttattgccctttacaggttgtactcctgaggtctttccttatttcttggcttccatatttgacgcaatctcctgtaaagtctttgagataaagtctcagtcagtgtaagagagaaggaaacaggcacctgcaagtgctgaatggtgacccaggcagaactcgtgctctaccctagaggcacccaccgtggaaggctgcttttctagcatgaggtaaaacttcagggacgggtgcggtgtctctcgcctgtaatcccagcactttgggaggccgaggcgggcggatcacgaggtcaggagatcgagaccatcctggctaacatggtgaaaccccgtctcttctaaaaatacaaaaaattagccgggcatggtggcgggcgcctgtagtcccagctactcgggaggctgaggcaggagaatgacatgaacccaggaggcatagcttgcagtaagccaagattgcgccactgcattccagcctgggcgagagagcaagactctgtctcaaaaaaaaaaaaaagaaaagaaaaaaagaaaaaacttcagaaagctggcttggggaagcatttccagaacgtgatcatagaatcctagcaactagggaaagatgagtcactgtgaggaggttgagtctgaagatacaaagcttcgaatttatcaccctgcattccacaaacaaccacagcatatgctttctccactgtttctcattttggtcactagagcacctgttctatggattgagcaagatgccagggagtgtcatctccctcttcctcatgaagcccccaccaccaccgcatccagtagtcaccgaatcgtgtacatcaagcctcctaaatatcttttaagtggacctatttccctcccactcccctatcaccactgtaaatgtcgccactgtagtggtctccttgcgtctgatcgctccttgctgcaatccattctccacgttgcagaagggatagtttgtaaaattcccatcaatgcataccagtgactgtggaatggacattagccagatccagcattttcagtcctttggctgctgcaaactttcttaaatcacactcctttcaacatgcagctccctctgcctggaatagccttcccctctgtctacctaggccttctcccttctgcgggtgtccagagaatggtcctcctttgtaaggtcttccttgaagtcccctgcttaccaccgtcctgctctgtgctccagatccttctctattttcccttccacagccctcctgccacttcactgtagtcatgttgcaactacccatcttctttggcacgaaggaagttctgacaggtttcacagccatgtctgtcttctccgtcactgtattctcagtacctattatagagtaaatgcttaaaaacataggatgaagaaaaagtggatctacaactagggacaaatttacaatgaggcaaccccaaggatgcttatcagaactctgcagattcaacagtgaaaatggcaggcatgataaatcaatgacttaaaaagagaagggagtttacataatctgcaagcactgagcaattctggccaagcagagggtatgggtgggtacaaggtggtgctttctactactcaccaggacagcatcactacaaggggaaggcaggtgtccacaggggtgaagaaaagagcaggatgagaggaggaatttggaaagttcacttttacatttcttctatggtccgctaagtacccattgcctgacacttagtaggcatccaacataaaattattattattattattattattattattttgagacagagttttgctcttgttgcccaggctggagtgcaatggcatgatctcggctcactgcaacctccacctaccgggttcaagtgattcgcctgtctcagcctcccgagtagctgggattacaggcgcacaccaccacgcccggctaatttttgtatttttagtagagacaggttttcatcatattggtcaggctggtctcgaacccctgacctcaggtgatccacccaccttggcctcccaaagtgctgggattacaggcatgagccaccatgcccggccccaacataaaattatttaatgagtggatataggttctacagcctcagagcccctgcaataccacagtattagactatccatatgtacccaaagtttatcattgtaatactctaaactctgtaagaagcctcagaatttcatcttaaagttgagtttctgagttagaccactggcaaatcagctgctctcactagatagtttttctccaaaccactcattcattaattcaagaaacatgtattgagaacctaccatatgccaccccctcttctaggaaatggggagacattactgaacaagacaaggtgcctccaatcatgaacgctattggagaagagagaaaacaaaaagtatataaactagaaagaatattatttcaagtaataggagggagaaaggaactaaacgcagaggaaaaagcaacagattttacatggggatagaatgtctagggaaggactctctggtgaggcaacctccaaggggccacgacggtggaaaaattaattccagggaatctggaaagaacattaaaagaaatagccttaagattgaaagccatgccattttaactcccgtggcatctggcacaacgcccagcccagaagtctcacctattcactcattcaatcttctgttcatttacgacctcattcattccttctacaaagggtcagtgaggattcacagcacaccaagcactgtgttagacagtaataatacaacaaacgtttattgctttattgggagaattagtgtgtatttgaacacattaaaacctccagtatttgacagattttgacatacaaatggcaacttcatgtaattcatagatgctatttatttctagattggtaagcacaaactattgggaagtaaataacgcattttggaaacttgatttttcaagttctttgtaagaactcttttacatagcattgtaaaagatattttacattgtacttttagttgcaaaggagttttataaacgggttatagcaaactttttaaggaactatataagttcctttaaggaactatttgtcaaccttattccatttacagctaatagttgaaacaaatgaaattgcattttcttaaaacatattatatttctaatccttctcccaagttaatgcaaatttagaaaattttgcatgtattggtatatatcacaattcccttcatttacctcccaattagaatttcagcctaaggctacctttgtaatttctcaatagagaaatgttttaaaatataatttcagataattcaaggaactgagttaaacaagtttggagcatatttttggtgacaactattggacatacgaattgtcaccaactgaaccatggtccattcggcctgccatgcccattccagaagatacccgagaagtcattgttgtcttaggccattcaaattttcgtttgcatctgtggccgtgagtatcacacactgtgtttcctgatatctagtgtaccagaaattttctgaattttccagtagtcattaatggctctttaattcatatactcattcaaaccctatggaattcatttacaatgaatcattataatatattctttaactcttggagtgatgaattttataggtatatttacaacagtgctacatagtccttctacagcttgtcaaatgcacatcacattcaagagattttgtgatgtcataatgtgatgttcctcttatctctgttactcattttgatatggaattggaatatatcctgttcccagttcacactcccttaagttaaagagatacattctttttacaacagagccttatgttttcatctggctaattcagaaggtaattccaacggtgaaaactatctcgagtggtaattatttgggcagtatcatttcatgctactcagaatccaaggaaaagtctctgatatcctggagacagcagtcttgattaaagagcctgagaccacttagctctttcagaagacctctgtaacctgaaatattgtagtgtaatttgtgccccaggtataatctaaaagcaaagttaacattctaccacatggtgactaaacaaacttattgtatattttaaaattaaattaagactaggttttaagtgatctcaccacaaaaaaaagaaagataagtaaataaggtaatacatatgttaattagctggatttaatcattccacaagatgtacatgtatcaaaacagcatgttgaacactataaatatatataacttttgtcaattaaaaataaattaaataataatgaagatgaattcctgttaacaactagaaaacaaacaatttgagggcaagttatgataaataatagtatgtaacactaaggcagacaacattatcctgacaaaatatgatttgtcttcttctttacacagatatcttgttctcttttgaccagagacaaaagaagaaaagtcttggaaacatccttcacagtttggggatgaatgaaggcagagaagtattcatcagtcttatgttcctggcaatgaaagtcaaaggaagtcaaaattgtggcttctagaaaagagaggagctgacatagccccagctccacctcccttgtctcaaagcataagagcataactgattattctcaacctcatccatacataaaaaagcgtgctaaacatttacttttgtatgactttagcaacaatcaaaataacttcataattttgcatttcctttttattatatataacatcatattttactatgtgtttccatatacctaacccttagatcctcctaagccctctgaatgggaagcaaaataggtatcgttacttttcaaatgaagaagccagagctcagtgcatagcagggacttgtctaaagtgatgtgggtaggaagtggtgaatccaaaagctgaagttctggtcttctaactcataatccggtgttattttcctttctatctttttttttctttttttaagatcagatgttcatagtaactgagcagtctctcagtgcacatggagtggttttaaaagtcaacattaatgttcaattctgctgcacggtgttgagtattctggaaagatctcaagaagagcctgatcccatgccagcagaggctctgttatgcatcctgcttttccttttaaggcattttaaattaaaggaagccttagacaccaccatttctttctgtcccactgacaaccaaatcctttcaacgaaagcaccaatttggtttagctacagattatttttatctgttcttgaaagtcacataaacgtgacctgaacaaatacgctcccctgcatgttcttcctgaatttcaaagtttttcagtaattaagcatttttcctagagtgttgcaaaccaaatagagttctgtgccaaagcaaggaacgcattaatgaaaacgaagaataaaaggaagccaaatccaagttgcaaaaaatgctctgccttattttgctgaaatgagatgcaaatatatatatataatatatatatatatatatgcaagctgaggactagagtaaatataatatgttgatgtgaattttcatactaaaatttttcaagaaaataaatatcccatctcaagatatgtttttttaaaaagaatcacacaatcacatgaattaaatgtgtgtcttggtaaatttagggatgttaataattcattccgataatagtattaaaccagaaaactttacagagtgaaaaagtaataatctagcaaagaatcctatcattggatttcacccaaaaaggcatcaaatcctctagattccatcaaatttctttaaaaggaaaaacactttttcttttcaggatgtcttagaagttttcattaaatcaaaaatgtgcacagcttatacagtggttctccagaaaacttcaaccacttggaacacatgtttgtgtttaggggaagacagagggaaaagagaggaaaggttgggaagaaagagatcataatggcttcaacaaaatttacaaccagtgattgtatgatattgtggcggcggcagctcctcacacaaaacagatggtacaatacagagctgtgtcttaaaatgccaagcaactaaagattcactgattccatctacttctgaagcctttcctaacaatctatgccccagagtcgacttcagaatatttttacgttttaattatccccttatttgaattactatagcaattatagcttcatacaggctcattatacatttaaacattaattttatgttttaaaactcaatactcttaggtcaaaagctcactagtgagatagtggagtggaacgttagtttcctatgtaacaaatgaccactgtaacaaattcccataaacttagtgccttaaaacaactcatatttattctcttgcatttctggaggtaagaaatctaaaacgagtttccttgggacaaaatcaagacctcagcgaggccctgctccctctggaggctatagaggagaatctgtttccttccttgccttttccagcttctagagctgcttgcctccctgggctagggcttcccttccatctacaagggaggagcagggcatctccaattctctctctgctccatcttcacatcgccttttcctctctatctgcagcaaatcttcctctgctccctcttataaggactctcacgattacatttaagacccacatggacaatgcagaataatctctcacctcaagacccgtaacttaatcacatctgcatcattccttttgccatgtcaggtaacattcacaacttccagggattaggacagggacgtctttggagtggactatcacaccctccacagcagcagaggttaacctcttaatgtcaatcatttagaactacagtcatccttcagtatacctgagggattggttccaagacccttccccataccaaaatccacagatgctcatgtccctgatatgtaatagtgtagcatttccatataacctatgcatatcctcccatgtactttaaattatctctagattacttacaatccctaatacaatataaatgctaagtaaatagttgttatactgtattgcttaggaaataacaagaaaaagtctgtacatgttcagtacagatagaaccacccttttattcccaaatatatttgatccacaggtggctgaatccatagacttggaacccatggatatggagagtcaactgttacttttaaatcaccttgcaaatgaaaatatgcttgctaaggttccttcaaaaagatcattcttaaaaagagttttggttagtgtagattccactcaaacttaatcctcagctccatgcatcattaaccttatggataaaaaattgtggggtgggatcctgcaattctctcgttctgtcaacagagaatactaaaaagtttaaagccatgttcctcaaaatgtttttctcctacacttaaatcgtattttcataacagcatttaatatactaaactacatcatagcctagcctagcctattctaagcatgctcaaaacattcccatgagcctacagttgcaaaaatcatttggcaactcagtccactgtagagtattggacatttacccttgtgatcaagtggctgacggagctgtgactgatggccactgcccagcatggtaagagagtgtccaccatatatcactaggctgagagaagatcaaaattcaaaatttaaagtacagctcctactgaatgtatatcatgttagcaccatcatgaagtcaaaaactgtaagtccaaccatctgaaggcagggaccatctctagttcgtcatgcaacggaaacttaaaaatgcctttaaaagttaacatagggcagcttaatttgacgttaagaaattttcattgagaaccttgaaataagtgtgaaaaatgcatgtgtaatatggttatggcaataggggagttggcaaagaacttgggagaacgtgcaatgttcccaattaattttagaccccataagaatgacacaaacagaagagcttgcagctgctaacaaatgacagatatgttctgtcacaccccggccagtccaaagggtaatgcagctaacctgatagtccccgggaatagcagctgtcaggaaggtgctgctacatgtcagatccagctccttaagagcaactgataagaaaaagatgaagaagaaaacagcttaatgtcagtgtaaaatctgaaattcacttaatcatgggattttaatttgttaaccttcccaaaaaatagtatgctaagaaccaaactgtgttccctagtcaaggtggagacccataggacatctcacttctccatcaactgccacccacgtagcacctcataaatgaaagtgggacagggacacttttctcttattaaatcattttctcatatctgaatatagttacgacatttgtgaaatcagtgcaaaaacaatctctttttattgaacgaaacatagcccaggtaccatgtgcttaattcaatttaactgaacaaatttactgaacacctacggtatataaagcactgtgcaaggcactgctgagtccaatgtgaaccctgcctttacagaggtgtgcagacatgcacacacacatacacagacacactcacatgacatacatacctctgcacacgtatacaccacacacagacacagatacgcaaacaccacgcaacacataaatacacacgtatacacacacaccacacacacacctgctgtccatgaagagcaggagttttgcccatcacatggagaacagggaacgtacacatggcaaggatttcatagcaccgttggaagcagcacttagaatctctagaaaaagagatttctcttatttaccatttctacactctctcacagtgaactacccgtatagtcagctgtgaaggttataacgcccactggacaaaattttaaaatgtagaaaactgtcttcactttagtatgaacaagagaatcctttgtcatcccaccccagggaaccagtgtgaagagacacgacagtttgtgtggagaaaggggttgaccatttacaaggagagagccatttcctaagacgttgcttcatcaaagcatcctggaaccccagaagagggaagagtatcaaaccgcatctgtgtgcaagaagcctggctcccctccccatgcaactggaagaccaatgagaatcagaaaagcagtgaccacgggccatcctggagccacatgggggcagcgtcttctgggacacaggggaagcactgagaggcatttaggaaccagggatccatggtcattcttacttaaagaacacacccattatttacatcctatcccaatggtggcaaaataataccactgagctgaaaaggatctctacattctaccaaatcctgttattctcacatgggcttcttcaaaagtatagaaggttgtcaatgtgaacacagtgcacttcatgactatcatatcaatccctgagtgtttactttcttctcagtgacattaacactggaacatccatgtcaaggaagtacgatctgttcttttcaaactaaaacatgtccagtccggagtgggtgggagcaagcccaccttgtggccactactgaactaccaaaactccaacagagaaaccaattctgtgaagcctatggggaatgccacattttttctaaagaaccataaattaagtttaaattcatgtggtctgttcactaaatgtctttgcagaaggaaaagggaattggctccaaggattgcagttgctctgaaagtgcatgtggcatcaatactcacttctctaagtggggtcccaggacctgtggcatcagtattatctggaaacagaaatgcagactctcaggttccacctcagaacccctggaccagcttctgcatctccacagaatccccaggtcctctgtgcctttaggttggagaatcagtggaataaacaccaggagtgcaaacaagatcaaagaagttacctgttgtagttcactttttcaaataattgactgaaattaatttttataattaatgaagctagtgatgatttggaatcccttgactaagagaagggttttaatgtaattaatctgcaaaatgatcagtttttgtgcatcactaaacctatgaagtttataaagattattttcctagctggttatgaagaaaataatgtcacaaaagcatctaagggctgtgccttaccaatgagccgaccctctccagtctgctttcctgtaatcatagtgactcaatttctagacttagaaagaaaaaacacagaaaactaacatagaggattgttctcccttctggtcacggtttatggtagcaacaggtgaaaaaggccaacagaagcaacgatttgcctcatcacattaaaagaaacatttgctttctcttccaaaagcgtaagtagtaactatggaaaccagacaaaaacgttgaaaatgacttgcaattcacaaagagcagaacaactctatttcacccaccaaaaaacaaaaaaattaacgatgaaaaaatccaccgaaaccttccccaagaagagctggatctgcagaagacataatgtgagtgctttgctcatgcaccatcataaattgtttgatttgctacagaattgttaaattatgtttttacaaatcggttatttagctgtgactccatttaaatctacaattttatgtgtcctgatgataaaatgggcccttagctgagccagctaattcctcaggtaaaaggcatattcttttggcagtaaattaactttggaaggtcagtaggtggcctatcaccaatgttagagatttaagaaatgcatattttgtctaaaacacttaatttacacctaaggaagctgaatgaatgatctcaaaatttccagctattatctgtttactaagttggtcctctggatatcctatttaaaggttgaaataaatgtacacatgatttatggagagaaaataaagcaggaaaacttcacccaattatgccaacctactcactgcccagaaatttccatccaattccactgccataagcaacttctctgtgtgttctcccatttatctgtttgatgttcctgtatccctcccccactttcagatcagatgttacttccttttcagacgagcttgtgcactgcttgatcttaatggaaccccataaggagaaaatgaccactttattttaaaaaacagaggagatgctgactcaaaacagaagagagtaaagaacttccttaaaaatatgaatctcagtgatacttttatagcccagaatgacatgtttatctttcacctattttttttttcactccaagcaagagcagaaaatttttttttaagcttgataagcaaagactcatttggggatacctgctacctgaattatcactatcagggttaaattaataactatggcatattataaagccataaatataattttgagctccactcttcccagcatatttatgtgagtttttgtctcattttgtgtgtttgtggtgagttttcttcctttctctgtaaaacatggagctgctaaggcatcagtctgttattgtatactgacggagtgtggaaataaatgccaatatcatttgcagagccatcctggttgtgacttttttttaggtgagtatcccactttcaactaaaacctagaaaaagaattctaaaacctttttcccaattaaatgttggcactcataacacattgttgatggattgaccaaattaaaaaacaaaaaatcttaagtttaatactgttttcttcagatggcatcaacagcgaagtatgtccctaaacttttcattgttcaatgctgggttgacaagcaagaaaaatctttttatcaccaaaatgcaaaaacaatctgaactagctgctgtgtccaatccagcttcgttttaatttggtgctaattctctaatttgctcatttattttctctaaccacataattaatgctgaagaaagtcttttacagcttgccactgagccctccatgtcttaatagaaggaaaaattccttagatatgtttcccatcaccatgcatgtgctgaagccaagaactagaaaaccgtaactgtgaagtattacgaaatccacacaattaagtgctgaaaccagcaagggccaaaaccactctgagacccagctcagaccaacccagcctgccctttcaagtctgtaaattggatcgcggtccagtgctttctcttacctcatcagccttcctttttccttttgctgtagtggtatgttttcaatgaactctgacatatttctctgattgaaaaccattttaatactcctagacaatgtgcttctgaaacattgtcacaacacatacaataaccaaaagtttagacctgtgtaaagcaaagtgaaaaatggagtgtcattgaatcccacaattctcgaaatacaagtttatgggaaaagccaaagagagccaagtgatatagtttccagccatggcacctcaggaaggcccctcacctggcctagcagcagccattcccacccccaaattgtaacctcagaggtacagaaccattctccaagtgctgtgacctttcctcctacaaatcattcatcagtccaacatttcctaagcacctactccaggccaggcactgttgtcaggactggacatacagtgaaggaagcaaaggctctgcctcgtgggacccacactccacgggaggaggtaaaccaccaaatacatgagtaaacctatggaggatgatggagaagagaacagaggaatggcgtgctgggaatagggcagggagggagtcgctgaaatggagtgaggggaacgtgagcctcttgaaggacagggcactggggcggagtcagaggggcttagaaggtgagggtgggtagggggaggacaggagctcagagcagggaggtgggagagcaggcactgctcaccagcatctgggcctattgaagatagggattggtctgggattggtctgttattccatattttatactctcccagccaggagatcaaagtcagtggcatcactggtaagtcctgtccatagcactcatccttgatatcatgatgatggcgctttatttctgtttccctccagaaaatcctagctccaggcaagtcatgagaaaaacctcagacacagccaaactgaggacatttgacaaactacctgatcagtcctcctgaaaaccatcaaggtcatccaaaacaaggaaagtctgagaaactgtcacagccaagagaagcctaaggagacaggcagctaactgcaatggagggtcctgcacaggatcctggcacagacaatggacatgagggaaaaagtgaggaagtcagaatagagcgtggccttcagtgagtaatgatgcatcagtgtcgcacattagctgtggccaatgtacacacaagtgcaaggcgttagcaataggggaacctgggcacagagtgcataggaactctccaaactgactttacaacttttctgggcatctaagactattctagaacattttttaggctaggcctggtggctcacacctgtaatcccagcactttgggaggctgaggcaggcagatcatttgaggtcaggagttcgagaccagcctggccaacatggcgaaaccccatctctactaaaatttaaaaaattagccgggcgtggtggcgcacgcctgcaaccccagctgctcgggaggctgaggtaggagaatcacttgaacccaggaggtggaggccgcagtgagcggagatcacgccactgcattccagcctgggcaacagagtgagatactgtcttaaaaaaataaaaataataaaaataaaatgaaatgtctttaaaagtttatcttgttaaaaaaagatgcaaatgctctctatctagaaataatgattccagaataaaaactgcaacaaacaaaaaaggtggatgtgaaacaactgtacaggtgaatgagtcaggatttaacaccgctcggtctattcctgctgagcggtttatgaaatctgctggagccctcacagctggccattccatttatttgaaactctgaatgattatgtttttccctattggtcccagctctttcttccagggccacacactacaaggaaaacctcctttcctgtcagcagtgcctcaagtcctcagagagagctttcctaataaagcacgcgctccctgcagccgtgttctgagcctcccttcaccccacaaatcatgcctggtctgactccaaggaggtgacctagacaccttacagggaggaggggcagagaggacagcacctgctcagttcaggctgcctgtcacacctgtcctcaggatcctccctccctctctttaggggtccagggtgccactgagaggctccacctgatttctgaggtccaagaccgtcctgggttccaaaacagggtctcagacagcctccccgtcgcatagccttcgcctgcatggattgaacttagcagccctttcttcttccctcctctgttacctccacagcctgacaccatggtgacacccacacatgactcaagaaaggatgttgacaacttccatgtagaaaggcaagatcgggctaatgtaataaataatctcataccttggaagcagtcagcctgcacgtacgagacagagaaaatgaggcagagacaaagggcgtaattgcaaataagaggagaagtaggaggggaacggtggctcacacctgtaatcccagcactttgggaggctaagatgggcagatcacctgaggtcaggagtccgagaacagcctggccaacatggtgaaaccctgtctctactaaaaatacaaacatttgctgggcatggtgctgcgtgcctctaatctcagctactcaggaggctgaggcaggagaatcgcttaggaggcagaggttgtggtgagccgagattgcgccattgcactccagcctgggcaacaagagcaaaactccatctcaaaaaaaataaataaataaaaaggaggggtaaagagtatgtctctttactctcctgtatgtgtttaactccacgccctccaaaatgaatgattttaacctggaaagttaaaccaaacatttgaggcccaccataactatggaactaacaatatttaaaggaatttgaaatttaccaaatttggtctccaatgacaagtatgattctgcatctcctgttgacatggaacatttcagttcatgagagaactggtcttcaactgaaattgaatgcacacagccttttatgcactgagatagacgtggcttcccttctcatagctcttcataatgttattaaacagtttctctagggccatttttacttctctaaatgatgacgcacatacatattttgagtttctgtggtctctttttttaacaagataaagcaagtagtaagtaataaaggtggtttcatgtacacagctaataagagtgtttaaaacctaatatcagctgaagaaatcttttccttatttatgtaaaatgggaattaactcatccagtcaagaggaaaatgaaatcaacaaatgaaacgtacacaagagaactgtaataattgccaaactcagctccgcagagaacaatgggattccagcagaacacagcacccgggcaatggcggaatgtgtgcatcgttgcctccttttccagagccttatcctatcacagccctgttagagatgtaagctcctggtctctctttgaagggtgtggtttcagtatctaaagtgattatcttacttaggttcatgaatcccataaaaatgcaggaattgtaaacatttaaagtgaaaatccttcctaggatgtctcatatcttagctataattgcaaccactccatattgtgtaaaattgtttacaaaaattcaaaaagccaaacaattaaacatattctaagtgtctctcaattgccatacaaatctataacgagggacaaagggaaggtgacatgactcagagtctcagcagtgagtcatcaatcatggcaaaataatcaccctcctgggtgaactctctttgtcaacagttggtctggaggaggaggcatacaggcatacaaaaatcagcaagttcttaaaagcatgcaaaaactgaattctctggacaaggtccagtgcaaataagttgggatgatcctcaggagcagaaaacaactctgtcaacaaggtgccacctccaggtcatcctctgtgctccgctcccttacagatggtgtacagggtcaattagtgtctgtcccctaaaagttcacgtccacttagaacctcagtgttatgttatcactatgttatagagcttttgcaaatagagttaaattaagatgaggtctaatatgctttaggttctgtgtccccacccaaatctcatgtcaaatcataatccccacatgttgaaggagaggcctggtgggaggtgattggatcatggggtggtttctaatggtttagcaccatccccctagtgcagtgttgtgatggagttctcacgaaatctggttgttgaaaagtatagttcttctccctttgagttgtctctcctgcctctatgtggaaaagagtgcttgcttctccttcaccttctgccatgactgtaagtttcctgaggcctccccagccatgcggaactatgagtcaactaaacatcttttcttcatgaattacccagtctcaggcagttatttaaagcaatgtgagaacggactaatacaagatcatactggattagagtgagccctaatgcaatgactggggtcttcataaaacggccacatgaaggcagagacacacagggagcactccacgtgactactgacatagacactccacactggaatgatgcttctacaagccaagaaatgccatgaactgccagcaattacaggaagctgaagatagacctggaatatactgtctctcggagccctttgaaccaatctgctaacaacttgatttcagacttctggcctccagaacttcaagagaataacttctcttgctttaagccaccgagtgtgtgctgatttgttatagtagccctaagaagcaaatacagatggtaacaatgaccacaaaaataatgatgaaagtccccttggtcacaatatcagtccttagctaattttcaaccattattaatgcaaaataaatatatacataaacactttttttgggtgacttgacaaatatttaatgaactattagttttcttcccatgaagggatttgagtgagggtcctgcctcacagtcatatactaaccatatatctattgaatgcccaaaatttgacactttggcttagataccatggcaggctaaaatcaagctaataaaaaagagagagaggaaaaaagagatttcagaggatactaatatttacaacaaagtttacaacctgttgtttgaatcatatgaaattgccaatagttgacctttcttgaactacaaaaatagctatttcatatggtttaggccaaaggttgaacactatggccataagccaaatctggcccactgcttctttatgtaaataaagtttcattggaacacagtcatgtcatatgtttgcatagtctcaatggttgttttcacgctacaacagcagaactgagtagtcatgacagagaccatataaccctagaagcccaacatacttattatttcaccttttacaagaaaactttgctgatccctgatttaacctaaaatgactggcagcaacagtaaaggcaccaggatttcagaagaagccaagatcaatgtaaaaggaatccttactagtgtgtccatctgagactccagacataaactgggacttgagaaagaagctgaattctaatgaagaaaaaaggctctcaatgcaacagttcaagctaaggacagaagggacaaggacccaggggatggcgaggatgataatggctgtactggcctttggccccaaataccaggagcacttgtctctcggagccttttcaaccaatctgctaacaccttgatttcagacttctggcctccagaacttcaatcactgggacacctcaaaatgcccccatttggttccaggtcctgtccctgctaaaatcctcacatgaagtagaactagaatgagaaaactttgataaggtttcagagatcaaaattctttgaacaccagactgagaaattgtatctttttttctttacgcatgaatcaatagaaggatatgtaaacagcatgatagaagagttatattaggaaaattaatttctgatagatgtgaaataattgagtctagagcaaaaactatattattcagaatatctattcctgtggccctttttagggttgtatgataaaggataattactccaatgattgcagtaattacactttaaagatttatagagagttctagagttgggaatccctttggggttattatcaaatagaaaagtaatcaaaaggagccttttctgcttcattaataggccacacattacagccaaaacataacctgctataaagcttgcattgtacatcgagctgcaaagtcttactaccaaatgcttcccagggatttataaatattgaaaggtagagaagaatttgcttgagtgaggaaagttctcctcttttccatttacttcaattatccaaaagcatattaaaaacatttaagtttaacattaaactagaaagccaagtgggatgtgttgtaagtaaattaatagctaaatagatatgtgcatgtttatcaacctgacattaaatgtatcttaaaccacatatataagagctgtcacagggtcatacagttcattgattttttcaaaactaattcacaggtacctttaattatgtaaaccagctgttcactgcctggtaaagacttcagcttgcaaagtaagaattatctacttagagagactgacctagaacacagttgctcccaattttttaaaggaaatggtgttacactgcagcaatttcttctcatgaacttgttagctatgagcccttgagccatcagcaactgaaggtccggagaagccccggagcagcttggcttcagctgtacattcacgtcccctagttcacattttgctggtggccagtgagacagggcctgcaggcaatgctcagagggtcaggatgctggaaattgccttagcactgtgggctttaggtgacaactcaagaactgggaaagctacccaccctactgggctgtcagtgacttcataagacaatgcatctacatagctcttgacatactcagtaaaagatgctggagtttttaacttctcaagctgttcccctttgcaatcacaaaaccaactgaaaattgatgttaatggtcattatcttggtgacagacatttcccagggtctcagaagggttgtatggcaaactccacctgggtatggtaaggggagtgtaagacggaaagtgtggatggaggccagggaaacacaagggatagtgcagcgacagggctagtcacagtgggctcagctatcaccttgaatcctgacagagtgggaggagtgagcacttaccaggtcccgagtgtgctgaggccttgggtggaaggatgcagccagacctaggagacccctcagagcacaagcccttctacctctcatcttctccatggcccccaagggaaaaagccaaccagaagcagagggctagcaagacttcaatgcagtccagagcctggaggaggctccagaggatctggaaggataagcagaagatgcccagcatacttctctttcttttttcctaccatcaagagatgtttgctcttatgcaaagtcaagcaacaattccaagccctggttttatttttagcaaattccaatttttcctctcatcttccttctcgctctctgtgtgggtgttcctgtgcaggtgaccaaacagaggtggcgattcaactgcattttgcaaagtgctttcaagtgaacaaagacattaaaccacacttcagcttgtaacaagaatttctatttcttgaatcatcacaaagtaatacttgctaacattatggagtgctcactatggaacaggcaatttacatgcattaacaatttctaatgttggcaaaacccctatgaggtaggaactattgctatcattttagaattggacaaagtggggcatggagagattgagcatgttcctcaggtcctcacagctaccaaggggcaggactgagcttcaaagcctgcaacctggatccaaaatctgctcatctaaccactacctttatactgcctcaaaattacagtgaaaaggcctagaagatcttgatatttaaagacatcctgcaactaatcttcttcatagaataaaaatatctatttttatgaaacaatcacctattttgtaatttgtaaatatgacatttgcacgtagcatttccttatgtgtccatgtgtcagtttccaaacattgtctttatagaaatgaaatagaatatgatcaacttaggtaagttcccactgcctaccaaagacttcagcttgcaaaatatgaatatctacttagtgagactgacctagaacacagttcatcccaattttctaaagaaaatggtgtcagccctcagttacactatagcaatttcttcccatggtctttttagcaacgaaccctcaagccatcagcaaccgaaggtccccaagaagtcctagggcagcctggcttcaggctacaagttcaggtccctgattacacatttatttttctgggttcctattcactaaacatgagaaatggggtgggagatggcattttccattatggcctcagcacagtctccccacccacaaattcttctgcagtgtgctttgccacttgcctgtccatgggcactctctccaaccccatgaatctgagccctaggactgctttgaccagtagaatacagtggaagtggtcctatgcctgtccttggcacagcctttaaagggcctagaaacgtccacttccagtatcgaagcccatgccttcccataaggacagagaggccatgtggcaggataccaggtgactgctactgcatgaggcccaaggagaaccactcagctgagcccagtccacccaaggaattgtgaaacataataacaaattgcaggtttaagtcactaaattatgggaaaattttctgtataccaatagatctccagaacaaatgagtttacctatttaatgcattttattttgggaagagggaaaaagataagagaactacattgtttgctcacattcccaggtagaacagtttcacctgggagccacgagtctctagatttcaggagaacctggctccagagaccaggcagggctttagggatagctggttcttaggtcatggtgattttatttgtaggactttgtacttacaagaaatccaaagagctaggcagaagagctgccttttctattctgaacccatggtagcactgtatccagatggttctggttatgaccacaagtcactccttccagttttgaaagcacaaccagctgtcagctccatcaaggtctgaggaactgccacccaactgtggccgtgtgctctagggatggtggccaagcctctggtgaaagggctacccacctgcacctgccagctttgcctctcaccatttccgccctgcatggctgaagcagaagtccccacagcctcctccccagctgccaggcttctcggcacctttcctagaggtcaggatcctacttggccagccctcgtgggcagcctgcccctgtgggaagccaagagcgtgacctgccctgcctggacacccaccagctgcacagctcctcccagtagcttccgggtatgggactgtggcctttatgtcatgctgagctacagagctgaaattactactaatatatttcaattaaaataaaataaaacatgtaatcttcatattccaggaatatttcagacattgacctataggcctctgccagccaacagtattaagacatctactaaactggggccagaattttttttccttcacattataaactagtaacatgctttcaaataccggactcctcctagtatttaaacccttataaaatccatgggtatatgaaagtaaatatgaacttagcttcctattgttcattcattctacgtgaagctcctcaagaagagggtgggggtaggaagtgtggaataaaaatcctttttggcaacctgagctattaccacattttctctccagtcttagaagactcagatcctcccttctttcatcttcccttgtatcattggacctgtagccctaggcatagttccctgaaacccaagtaccatcagatccgaaaggtgtcacgtggaaatagcctcaatacctggtgttcgacaaggctcagcagccagcacaggctctgaagagcaggcaaaggcaaggcagaggctgggaagccccagggaggtgtgcgggccgcgttaggatggacatttgtgcataactcttgccgctctgactctctgcctcctctggccatgttagatgcgaccatttccacagatacgttccacaagcaaagccagcaactgtttgctgtgttgagttataccatggagggacagatcatgtgttaaaaagaaaaaaaaatgtgcttacacatggttgcttgtgatgacagctgagttcagagatttccatcttgtatgatattcacatttttatatgtagtcttttgagattgcacagaatttgatggataattacagcataaatacatttatccaaattaaacatccaaaaagaaactacatgcaaatttataaactcttccagtctcaaccaacacactgaccaaataaataataaaatgttctttttttttattttaaagttatttgccaaaatgtatccccaaaccaggtgcttctctttcaggtttacataaaaggacaaaaggaagaaaacagaatagaagttaattattctggttcacaagcccttatgtaaggagaaatgattaattaattgcatttgcccacatcttgagaaatgcaaatagtctttggtattctgaccactcaactcagacctcagctgcactcaggatgcatctatagtgggcagtagaagcgaggagagatccttctccagagctcagaggctaatcaaggaatcttgacttgcacaatggaatcacctggaaaaggagctttccaggaaaccccaactcctatgctaaggagctacaaaatcggagggagagaggcgagaatgtgccgccagtcagcagggaagcctccttagaagtgagttataagcagcttcattacctgactgctctagctccaagtaccctcttcacatcttgaggcttttccattcccagaaaggtcagcctcctcttccttatcctgactgcaaagtgttttcaacactggaaaaggtcatcttgcaatgaagatgaataatgtgggttttgtccctaaaaaactccaggaagcatcttgcgtgggagtccttgtgagacctcgagcacatcagatatcaaggtctctgcatcaagcactctgaccagaaacagcccccagaacaaggtcctagagaggtgaccagctccaaacttctctatgatcctgaaaaggaagactgtaaatagttctatcttttctttggcactcttgagaccatttctggtcttcaggccacctacattcgtagggaactatatctgcagacaccatatcctggctttgtgtggtttgacagatgtggctgtgtaccctgagctggagggtcctctcagagccctgggcaagtaccaacagtgtatctgtgccagatgggcatgtacctttgaagcttccttcagccccagcaagtgaggaagctccctcagggcatgcagacacacaggactctttctgtcattcactgtcccacaccccactcttcctctctcctgctgtcactgcaattctgccctgaggttcctaggaaagcctcagggtttgattgaattgaacctgcaacattggttcaggtccttgaggcacgctggcaaaaaatggtatccatgccaggacaagggacacccaactggaaaacagataccgagagaggaaaaaccatctctagcctctacacactgtcttcccagggcagagcctagggtctgtcccagagaaagtttctagtaaatatcctgcttcatagaccaaatactaccatttaccctagtatctttgctggagcaagacacactaaaagcaaacaagtgatccaagttataatgggaccccatcataagcccctctctaagaagataatagatgaccatctctctatgaagtttagaaaaagacctacctgtggacaaagagataaattggaaaacctcagttgtgtcttccaggttctagaaatctatggaatgtttttatcaacctgaaggcagtcaatattcaatgaataaggcacaataattcaccaaatccatatccctttctttgactcaaatctatcctatctgccacatcagtttaggacaacagaaagtgtttgtcagaataaagatcttaaatatcccccccatcctcttatcaactacatattactttacaggtgaacaaaaaaccttggggaaaaacagtaatcaatgaacttttttttttttttgagacagagtctcgctctatcgcccaggctggagtacaatggtgtgatctcggctcactgcaacctccgcttcctgggttcaagcatttctcctgcctcagcctcccaagtagctgggattacaggtgcctgccaccatgcccagttaatttttttctttttttttttttttttttgtatttttagtagagacggggttttgccatgttggccagcctggtctcgaactcctgacctcaggtggtccacccacctcggcctcccaaagtgctgggattacaggcatgagccactgtgcccgacctgcatgtgtatttaataagaaggcatttctctagacatggggaaatgtaaatataattctttcaaagagaaatggtcatttgtctctccgatgattggggacgagtgttatcacagatcttttcacagagggcaactgtatcttccttttattttccacagataaaggttgccatgatagccaagccctttctccaccaggcttctcctttgacacttttttcatgtaaaccaaagagaagagtgaggggaaaaatctcagctgttctcctttatgctccctgccaatacaataaacatgtccttggtaggtattaatggtccttaccaccaaaagactgtcatcttctaatagcctgcaactgctcccaatttcatgcagtgttcactttgtcaagcacctaattccaaagcctccaacccccatgcttacaaatagaggttattcttttgttttctccaaagaatgaagcatcctttgaccaaagccatcaatcctagtgttagatttaggttgacaattgaaagatgttgaacacgccaattcgtctgagcccatgatactgtggtgtccaagataccatcactaattttggatcattggaaatattccaccacaggatacatttgaacttgttaaaaatagcccagctacccctctgaacatttcaacttactgtggcatcaacagagacatgctcctagttacaacattggcttgctcctctggaatgcaggaaaggagtcaaatttcatgatacggaattttcgagtttgtccataagatttttaaaatagacctttcactttagtgtaaaaggttacatacatagtaaaagattgtaaatatagaatttaatgtcttttctccaagtatgaacagaccatattgtatattttaggtataaaatattcatctaaaatattcagtatgaaacaattgatactattttcagaatactccctgtgcctccactctacttaaatatagagcatttaattaagtgaatccaattaatcatgtgaaagttaatgtgggaaaaggaaacagctaataaactcccaatggctcagagaagcaaagcatttcaaacatgcagactttacaagtttcctatgtgcctctaattatgtctttatacaaattcctttagctttctaccaattctgagaagtctaaggccaaattcttttctataaatatatctacaaaaactttttcttcccacacataggaaagacacaaaagatcgagtgagctggaacccgtggcccccttcctcatgggtttttaaaacatctgacataaactgcaacatatttgggccactgcaattatcaagcaaaaccgcaaaccagcagaagtcaaagtcaaccccaaaagctgtgttgaaaaagatacaccagcactcacctgaagaggaacaaagataaaagcgagtgaccctataaactttcaagaaagcagctttccctaacctgcttttgattagtgttcataggtttagccctgaaggcttaattaaacccagtagccaactctgtctcacttaaaagtgcaattaaagaatccacaaaggccactgggccctgagggcctcccacatgaggccccactatgagcaattcactaattgcgccctttgtcccccgactcttaatgatgacgctgccacacccccagtcaagatgcttattctccccacttagggccagctccaaaaacctcaaggcaggaagtgtgggcccaaaagcctgttctgcagagaacatacacttttaattaaacaacaacaaattaaaagctcattgaaaaacacttagcaacaaatccaaaactgcactaaagtccatgtgttaccaccactaattaaaaggactcttgattacagatcattgggtgtgatcttgtagccaggacttattaagggccatgatggagcccactctgaggggcaagccagccagtgttgcatccccatggaacatcatggtaccagaaagcggtcccgatccagaccccaagagagagttcttgcacctcgtgcaagaaagaattcaaggcgagtccataaagtgaaagcaagtttattaaaagcaaagaaataaaagaatggctactccacaggcacagcagtggcagtggcacgggcagcatggggcgggggttgtttagaattttatttggggtttacattgggcaagtcagtcttctcctctagccatagtccaagttcaaaacattgatttccttcagcctacctcaatagacaattcctcaatagatactctctttaaaaatgcctttcaggatttcaatggacagggcacataaccacagtgaagcctgactcttgtcctgacttgtgtaagacttcaggacctaaagtccaagcacctacattgactccttgaagttgtagagagcgacctgactgcaaagtcgggtcagggctgaatgaggtgtgagccccgggaaagcccttctgctcttcccacctcccagcttcatcctgaagatcctcgctgtgaatccttaagggctttcctatgcagcaagacaaacctcagggagctggaaactccgcaggtgggcctggaaaaactgttcaaagttaagtaacattcgcaggcgtaagctttcaagtgaatgaatctttgcgattcttacttgccagcttgcagtttcctgaatgatttcttttcgcaagctggtgatagaacctaggaattccatcactgctggcagacggaaagtaaatttggctccaggcctgactttcggagtcagcgtggaaagctgcaacagccaagatgggctgcctggacacgctgagatgctctctctatatggggcccctccttcccaactctcacctccactctcccaacccacccacgaccgctacacaattgacattcagtgtgacattcttaggtgaagaaagctttagaaaaaaatactagtttaaagtatgtgttgtttaaaaaaaaaatgcagggaggagtggatcggcagagtgggaatactttcaactcaaccacctgggttgggttcaggtcttcccacttgctcagcaccacctttgaggagtaaggaggcgaaggaagtgagagtgattcaaagatggaaaagaggggggcctttaagaagcatagcctggaaactccagatttttcccaccaggaaccaggaatgaagaagggagggaatctctactgccctgcggcaagccaggagagagttaccccacgggcagatgctggatcttcccaagctcaagagcaccgtccagtgtgatgcagacgtcgggatgtaactgaatagccatacgtgcctgtcatactcagaactgacttagatgtggtcctgtctataggcgccaacatgaaaccacccaggaacaagactaggagaaaaaggacacgtgctcctgctcctgtcatagcagcagcagcttgaatcccacagcaaagtggccagatgcttacagacacctgataatatcagacacagagcacaaaacttggtgcacccacttttacatgggtttgggggaggacggtttggctcaaaactttctggtgaacaaagagcataataattaaaattattttggtttagcagagaaattaaccagaggacgacaatcataaggagggggaaaaggaaaattcctctgatagatgggggaaaagtcactaaagggtatctgaagagcagccctatgcaaaaagacaggaggccaggcacagtggctgatgcctataatcccagcatttcgggaggccaaggtgggtggatcacttcagctcaggagttcgagaccagcctgaccaacatggtgaaaccctgtctctactaaaaatacaaaaattagctgggcatgatggtgcatgcttgtattcccagctacttgggaggctgaggcaggagaatcacttgaacccgggaggcagaggttacagtgagccgagatcgcaccactgcactccagcctggagaacagaacaagactccgtctcaaaaaagaaaaaaaaaaaaagacaggaaactgcagtctaggatttccctttccagtttagatcacccagacaccctgtcctgggcaaaggctcaataatatctggacaatggacccctgctctgtaaaacaccatttttcttttctatttacagcctggaaatattaaacttaaataaaatgtctatctttaactcctaggctcaagcttcaatgaagtttctcttcactgacactggcaaagatattctgattttaaacttcagaacagtgacaggaggacaggaggtgccgcagacacaaggcattggacatgggcaccctgccaggctgtgaagtgaacattcgaggcccttccctagcttctaacctgtcagaataaggttaaaatcccatacatcttagagtgtccaaaatcaatattagaggctaacatttggatgcttttcaaaaaagaaaatggttagaaaaagtagaaatcattaaaaaaaatggtctaatacattttatccacttaggacaatgccttcacataattctatacataacactatgagctgctttaattatgatcaactgaagctaccggaaccaatacaaatctatgattaaaggagattttaaaataagggaaaattaccttgctttcttaatccttctgtttcaaaactaaatacctgccctggtaacacagacatttttccaatcttgtaaccagccagtctgtttaactgaatggctaattagttatccttgaaatctagagaacattagcttgttgaaaatgaaagaaaaccaaaccacaaaaagtacctacctaaacagtattttattgactaactgaaaccatcaaaagtggtatgaaagataaaaatgtcacccaccccactgccatctaatcagcagaaggaaatattagtgtatcctcataaataactccttaccactcatgaagggtgataatttaggattggtaatagaaaaacatggtcgttctgtaaatgttactcttaatttgcttgtaagctaggcttcatgtttggaaagaggcaagttcaaagtgagctggtcagaaatgaccctggcaaaaggtcaataaagctattgcactaggacttaaaacgctgttgatctccatttttgtgaacaagtaactagaaatactgaagaaattaggcactatgaaaatgcttgcctgaagcatcacagggctggataaaaaaatactctattaccagtggagaaatgcatatgagtgctaaaggccagctagcctggaccacatccccaaagccatgctgagtgtatctggaccatggaccacctgtgccaaagtaaacactcccatggaaagccactatgtggaaaccaactggtgtgaggaaagcaaggtgcccacaagagagctgaggaagcctgtggcaggaggcagagaggattttaatacactaaacagatggaaggtgcagtaaacaaggtgggagagctaaagacactcacttctacccagagaaaacagtggaagagcaaggaaatgagaggcaattcgtatgtatctctacccaaaacctatattcagcattacattttaactgcaaaatgtgccaaagcagaatggaaagagctagaagcaattctttgattcttctctaagagcggggcggggggaggtgcgcggggtgggaaacactcccctttaaatactcaggctctgggcatttaaaactctgcattctgccactgggtctggctgttagaagttacctgccactccagctgaagcgaaggccttgctaagaaagtgtacaaggacacagaagcaggcatcatgaacttctcccccatcaaaggacagcaacctcatttgttgagcagaatgatgctaggagttccagactctgcagctctaatgagaccacaagattctgtgttgtcaaagatgttccccctgagctatgcccataaaacaataaaattggcagagaagcatactctaagcaatgactgggaattggggtgtacccaacattcagcggcgaggctggctgatgagtttaactgatttaatctggttatgttgtcgcatccggaaacaacctaagtttgcttgttttcataacagagatcacagctcagatagacttcccaggaagaaagtgtttcagtatcaaagaaatgtgctcatcctagcacccactggccctggcgctaagctttgtacaagtaatgtaaacacagaaaacatttcccagtagacgcagcaggactcgtatttaggccactggctgtttaatttactctaattttagagatgatgtccagaattttctttttaaaaaagttttattgaggtatatgttacatgccataaaatgtactctttgtaagtgtacaatttaatgatttttagtacatgtacagagttgtatgacaatctccacaattcagtttcttaccatttccatcacccccaaaaggcctaggctgcccatctgcagtcatgtccagttcccactgctagcccgaggcaaccactcacctgcctgccatctttatgggtttgccttttctgggcatctctataaatggaaatacatggtgtgtggtcttcagtgactggcttccttcacttggcacaaggttttgaggttcatacatattgcagcatatatcaagagttcatttgttttattgctgaatagtagcccattgtagggataggccacattttgtttacctattcttctgtttcaacttattaaatctataaatccaactacatgactaggcttattagtctgatcttggaaatataagaaaaagcctgccatatttttaaaatattctaggatgtctaaaatctctgtaatgtgtaaacatatgtaataaagacacaatatgttccctggaatttgtgtgcttggaggagagggtgctgttttaaatgagaacatccctgaatttcaatttttctgtgttttaatacagattaagtatcccttacccaaaatgcttgggaccagaagtatttcagatttgggattttctcagattttggaatatttgtattatatatattagcatttttagggtcatgtcggtgctcagaaagtttcagattttgaagcattgtggaattgggattttttgattaggaatattcaatctgtacacagaaattatatttatgctaatctccaagtcatgcaaggtcgtcaattcatttaacaagcactgacttactgtgcaaattgttgtgtattaggaactaggaaatatgcagtccctctcccaaccctccacctgccagtttacaaagacatttgtattttaagactgtgctaaaaaatcagtttggaggcatttggaacatttttctctaaataaagaatataagtagttttagagtccatggttagcccccaaaagtcttgcttaagccttagtcctttctctcagtatactctattgcagtctatactatatacatagtctctaagggcattttttgattcggtcacttacccaagatggcccgagagcctcctgcgtgccaggcactgttctaggcagcgtgggcaacacagctgcgaacaaaacagtctcattggtctcctaagctgacattctgtatcagtgaaagactttaagaaataaaggcagtgcgtggagttctgcaaaatgatatggagagaaggccgggcgcggtggctcacgcctgtaatcccagcactttgggaggccgaggcgggtggatcacgaggtcaggagatcgagaccatccaggctaacatggtgaaaccccgtctctactaaaaattcaaaaaaaaaaaaaaattagctgggcatgtggcggacacctgtagtcccagctgctcaggaggatgaggcataagaattgcttaaacctaggaggcagaggttgcagtgagccaagatcgcgccactgcaccccagccagggtgacagagcaagactctgtctcaaaaataagaaaaaaagaaaagaaaatcagtagttttacaacaaacctaaatctcagtcctgtaaaaggagtcacggaagccagttgtgattctaaaatccatttgtttacaggatgcccaaccataaatgtccctggcctccgaagcgttctctttccacagcaggtttgggggcactggcaggagtcagctgccttggtagctggctcagaacagctttgggggccctctgcaagacgtgtcacatctccggttttgttttgttttgtttttacagaaagaaaagctctttgtgtggaattttatttgaagtcactttgtgaggaatgccatctctgctgtgattcaggagaatagaagtttcggttttatgattttgcagacagatcacaggaaactgcttagcaaattttttcttagttgctttccttgactctgtttttctttccatgagtacatcatacatccttgccaaacattgggtggatttgaactgattgaaagaggctcgattttctgtgaacgatttgtccttgtgttatcctgattgtcactcgcctataacttacttaatttcacgtctcaacaaatatagtattatttcacccacagagttggcttctgatagaatcactctactggttatttatcatacatatctgtaattgaattacctattgcagtagtgtaatttactctcaattgtacataaaaatgtaacataaaataacatttttccagtgtatacttcctcattattctacatgaaccctagtttagccaattctacagaaatacagtgacaaataatgagtgaaagatgggaagataaaagattagtgggctcatgacctttcaataataaaagaatttcatcctctaaaaaaattattctcttttaaaatagttttttttccccaagtgttaatcaggaaaccaattctaggaaaccaataaggaaaaaaagagtttaaaaacagaatgattttcttttttccaaatgcagcaatactatgtcactacattttaaaatgtaggaaagggaaataaagtgtgcttgtctttgctcttgtcaaacaaccattaatcttggaccaaaaaagaagaaagaagatgacaacagcaattcctttgggaaatttttctgttttcttgatccactgttgtgtcactcctactttaaatttcatgcacaaggtgaaatatgacttgtctttgaagttgcctggcttcaaaatactctgtgaaatggacagcctggtttccttagctatacaaccttttagatggcaaagactgtcaatactagtatgttgaaataaattacctattatccaataccttctcttgggtcaagttttcatttgttttgttctattttgcttcaattttgaatcgaagcaagttttgagcaggttcatttatattgaaaagtttatgtatattctagcttactttaattttgctttttcttcttttctccctatcagaaattgattttgtatatctggataaccaattcttaaaaaattcatctgaaaaatatgctatatatttaccaagcgtacccatatctgtttctccaaagtgcttcccagcagccacatctcacctgctgaatttatccccaagttgctcccaatctatacaggaattggaaacaggagattgccccctatcatttctgcagggtagcagagtgataaaaacctaattttcaaccaaacttctgcatctcaattttaaaaggttgctgagaacatatgtgaaattatctatgttgtcaactgtactcaagacaactgaaagtacttatagacgctcattttatgattcaagaaaacagttaactttcttggtataaatttgcaagtagatgcaggtgagcagaaatgtacaatgcttcactttagacactttgtacttagttgtaactcaatttgttagacaccataatttacattttaaacattatttaacacataaaaacttgtcaccttggtataattataccccaagcaatttgtctgggtaactatagcaacaattgcagaaacatttttaaatacaaaattggtataattttagaatcaagaattatggaggatttattgcaggatgtacggctgctgtactcaaatagttgtacatatactactataaaaatggattccttgactgggatatgttataaactcatttgttctatcttgcacaccatctgctttgtagctcaaacctcttccttgggatgagtttttgatattagttaactctagggttcatgatcacttgtctacataatgcaatgcctttatactcttggctggacatttagtaaaggttttctgctcctcctccacatcttcctgtatcaaaagcaaaggctcaatttcaatgactttatgaccaaaaataaaatcacttgaaactcttaaaactaatcaccaagttaagtaaaactgtgtcacgattcagataggcagctctctctaacatcaggagcatctgacattgtccccaaagagctggcatctgttattttgggccactagcacacggtacagagaaaggcttgttggttgtaacatttgtccttcagcaagaggctaacatgactctggaactaaatttcttactgcaaatccatggacggggcttcagaaggcccatgactctaaaatttatgcagaagtttgtataaatgtgcttgtatttatttcggtctcgtggtcaataagttttaacagcctctgagctgtaagtttctacgtttcattctcccaagacacgtgatgaaatcattttaaagggaaacggcagtgaagaacgcaggtttatttttaccaaattctgaacgtctcaaaaatttcctctggacagagacaagctttaccacccaggaggccaaagctttactcgcagcagggatctcgcagctgtttgacattataacaaccaaatgagttagtgcaattcacaaaagacataaaatgattagcatcatctgtcttctccctgttaataaaagtacatattggctaaaagcacatagaaatagatgtcagtttgtcaaccccacacttcaatgagtatacagatgcttagtgtgactgcatggagcaacgtggatgagcaagcttctatctccaaagtttttacaagaaagaaactcaagggaaaaaacatctgtgtttcaagtgaaccaaacaattacacttagggctgtatttttcatgaaaaaaaaaaaaaaacatagaaaaagaaatcttttggaggggaaaaaaaaatccatgtttcttttggtgtaaatacaggcacagacaagaaaattatttcagttatacataacttaatggtattatctgcttgaactgaagttgtgtaaagtggtcatgataaacattacactctctaaaataatgaaactggcattaattagcaacaaattcagcaatcctaattaggtattgaaaaatctttcttattaaagcctggttttgtgtttctgtctccttatgaacagactacctctataattaataacatatctgctgattccaaactcagccattatgacagagctcttctcggtaagctagacgtaaaacttgtctttcttcaaaacaaaccagaacaatcatttgtgactcctgatgtgttaactaaagtacccctaaaaagcagaacggtattaaacaaagctcacgttatcttccctcaatttcgatttctttctgagtaaatgtaacagtcacaaggaaggcagatgcccagacaaggaagactttacagcgatctttttctctggaagagacctttctagttagagcatttatgtctggccaccacctttcctgtcccctctcctagcaaggctgacagctctctatagccaccagatcagctcccccaacccccggcccccaaaatgaaattattgcaagatctgcctggttctgctgtttgttgcctgggactcccgcccactcgcccaggacccagcaactgcctgtggcgcctcgtcctccgagcgctcgctcgcagcgccccctgccgggaatcccgaggacgccgcaggcgcaggaaagttaaatcccaactccggccgcggcatcctggtacaaagcaagcaaagggcgaggaggtgaacgcgcttcccgccaaagccaggggaacagggatgtgaccgctccaagccaggcaccggccgccgcggggagcgagccgggggaatcactcctccacgaccgttcccacgcacatcttgggagaaaccattccctctggagcccgatctgcccgaaaccctggggtctgaaaccctgagccgcggtgtgcaaaatccgtggagcagcggagggatgcctggtgaaaggggctcgcctagctgcagcgcacctggctggtggttccccaggcctctgcatcccccgccttagtgtctttcattaaccaaggcgcttggcggagttgagcccaagtcccattgcctcccggttcccctgtaaggaaagcaggaaaacctgcccaagccggtggggctgcgaggtggccgctcccgaaccgccaagtcccgacctccgtgtcccctgcccccggctcgcggcagtgcgagcctggaggcgcgccgggggcgggcacagaccagtgtgcgcacctttccgggtgttgggcaggggtcccgtctcgcccaccgcgacactccggctccttacctctccatgctcagacctcggcacaggcgggtacacaaacttccagcccgtgcactagctcaactgtgggcgcccccggactgacggtcgtcctaatcctgtacgcgcaacccccgcccaggtgcctgctgatggatcccacccgagatcggcaccacccaccagccgaccgctgcagtccccgggtcccggccagcggcgcggcgcggcgcggcgcggtcaggggctcctgccaaggccacgcaggaatcgggcgggggtcgctcaccaggtgcgaggagcgctggtgccagtcatccagcgcctgggggccagagcggctccgaggatcctcttcagcacctggctagggaagtggaggcagcagctgcagccgccccctgccacttccccagagccgccccctactcgctgagttccagaatgggggcaccggcttgggggccacgagcacggtccccgagcgcgcggccaaccggtgggtgggcaggttcgcgcccagcagagacgaccctcgaggtggcaaagttgggtgtccaagccagctccgcggggcagtcctgggtgggagaagggagcgtcccgggatgagcgacactggccgggccgcccctgcacggggaaggtggagggccggggctgcagcgggccaagggccgcggctggcctgaggctgcgaagcccacccgcggcgggaaagcagcgctcgggagcgggctcagggagagcagccgccaccggcgccgccttcccggcaagtagatcggcgcggggcgagcgggcgcggagagcgcggggcggagagcgctgggcggggagcgggggacagcctgggcccacccccgccccgccccgcccctgccccgcccccgccgccgcgccgcctcctcctcctcctcctccccgccggggtgaaactcgagcgccccacccgcgcctgacctccccgagcccctccccgggccccgccccttcccggtacaggacccccaccttcgctcctgggagccccgctgcaccccaggagttccattccagcctccccagtgcgagtgcggccgagcgctgacttttgggggctccctcccccgtctcactgggtccctctgcggctcccccgcccgctgtcccggttcagacgtggctgcaccccggaggggggcgccggccgagacctgagacgtggcgctccctctctgccggcctcggcttcaggtacgtgcggttccctcggctaaatctggcccgggggatggggggcaggggccgtctggtcctccggaactcgaactttgtgattttgttctttctgtgtgacatcctcatccgttctgagggagaaactccttaaagaagacgagagagtcagtcgttgcgggttcttggaggagcactttgggggtgagactcccggctagttcgggtcgatttcagcgggattaagtcaaggaaatgaacaaatctgacgaatcagggaggccagagaaggcgtccccaggtagccacgctgagcgttaagagagaagtcccgtatggtcaaagtcattcgtccaattctgtgtcaattattccttgttgcacttttgcaggatccttgggccttactaagtactcaggtgaaaagttgataattgggaagcaagtaaagtacctttgaagacgtgtataattggacactttgttgcagttcttcagtttctggaggaggcggtggggggggagagggagggggtcagcctcgcgaaaagagcaaatggtaaagttataggagtataaggcataaaacttgggttgggagtcctgactggccttgagtggccctttcccactggatgggggtgcgggacagtatctctgggccctttttactcagtctgcgcctcagagggaggcttgaaggtcccctgcatgaggaaatgtgtgaattgccccctcctgaccgcagtgaggtagggacccccgcaaggacccacgttcacaccagcgcccttccagccagtggtggggtatggatgggcctcgctggtcctgggcatggtccggtgcgtccataagggttccattgagctcatccataaaacaaagaagctattgcaggctgcagggtgtcatagctcgcacagtagccatgcagacctaagaggacaatggaaatacaaattgctatcgatgtgtctttattttctagaacttttttttaaaataaaagaattaagtgaaagcaattccgaaggtttctatgaaagcccagcccatccccaaatgcccagtctctggcacgggtgatctggctgtcttgggtactcaggccttactgggatttcctttaagacctctgggaggaagtgtcagtagctgggcaggccttcttggcaagcattcctccctgggttgtggcgggggctcccggcctgctgtgtggcagctgcaggctcctggggacctgaaggaaaagcttaaccgttctcccttcccttgcttggcacttagagcactagttccattccagacattccgattatcttgcctacgtggcacagaggcctaggagcctccctgggaggaagaggcaggccaaggtcttgcctggctgcttctagggggaaagatgtagggaggaagctgccttatgcttggatctgcagcctttgcctggacctgtggagcctacgtggccagggtgagggagacagaaattagaacccaatgtattcagctaatcctcttcttgcctctgaacattgccgttaatacttgaaaagaaaaaaaaaaagcaaaaaaactcttggcatatagagctaagcagtgggaagaagatagctttctaaaccatgacccaataggtctgataacataacatttaactggataaattacataattttgtatatatgtaggggggagttgaattcagttttgctgtttacaggctgcaccaatgcattgttaaaagatgtatattttagtgataattgtgattaattacaaaataattgctaataagcaggtaaataaaccaaattataatttagagtgcatcctttgtttaaagtgaaatggatctaaattgaggatataattttgagttttaatctggggaaagttctttaacttttctgagctacagtctcttcacctggagcttagacacaccagcctggcaggggtatgtcagctgtctgcttgaaaggagaaagacagtaatctgtgtgaaatactcaccgagcacccaacatataagcaggctcttcataaagtcattttgaggtatccacaagtatttcttttttctaaacaaaatttctttgttttttgtttgttttgctttgcaaaggtcttgcttgctagaaagctatctgcattaagctgcttctcatcacattataaaactaaggatgatcatttttaaacaaacaaaagtatttagttatcttttcaaagtaaaatatagctttccctaaactgttttaggtgagccatgcacacaatgtgaaagaatgaagaaaccaacaaaacacttggtgaaaatgatgaattctggggcgctgattcatgtgacttgaaaaatgccatccatttcctgattcacctcaattctgttcggaactatgaaagatcatttatgtttctgcactaattgaccaattttgtcttgtctttacttccctccctagtgcttgaatttcagccacatccctaagctgccatctcagaccagaggaacagggaggggggctttctggaaagaacatcacctggaagaaatcaggacatgactgtgggccatgagtgaccttcaaaggaaagccgggtatctgtggtctttaagatgtggtaagattgtattaaaattatagaaaaaaacctcaatccagaaatcgtggcctcttgacatttacatcttaactgcattttcctaccaatgagatgcattacaatcatcctccataagtgttctctttttacccctgtttccattcttttagatccatgacatttaaaaactgaagaaatggaaagatcatctgatcaggcccatcagtctttttcctaatgctaaacattggtacaaagacgtgaagtttgatgtctcactaagattgcctagggctgctttattgctcacctacttcaaagtattgggaaaacatgattatgggtacaggtgatgctgtgttgcccccagacaggtttcttttgtcaggttcttttgatggattaggaacctacaagtggggagattttagggaaatagcccctccacttggatttcaccaaaacgtctttagggttctcttaccccaagaaacacgcattcctctttagtgtggcagcccactctattggcaaagttaagcagaccagttttactaaaaaggagccacccagaaacttagacagaaaatacttgaggcacagatgagaatgagcacaaatgtgcatagcaagtgcagtttcctggcccttaaactgaagggccaggtcagtctgctcctccaggcacagcctgggaccccatcatgtgccccactctgcagtctgagcttccactcaagtccaccagggcctgcctcacatatatatacaagacccaatgtcagagtctgcctctgcccatgtctggtcagagggttgcactttgccactgctacatgttcccagaggttggcacagcatgacctggacctcacctaacccaggcaaactctgctcatcttcgagctctctggaacccatttctcaagggagaaccacattcccccacctcacagccaagttcaaggaagcagcctggctaaagcaatgactcaaggataccagaagcagagcacgcatttaagaagatgcgctgactcgcaggagcagctgactcttcttaagaagagtttactgattcttctttcagtacgggccttttaataagatattgtattttacttcagctatgggtgcagacaattaaaggattctagaaatctgaaagtgttttgccttgtcctcttggttaaatttctggatatattgtctagcaactcaatttgcttaaacaaaattgttgtgtcaaaaaagcccaagtcatcttttataagtgtggtctggggagaagaaaaaaatgctaagtttaaaagatttttggaatatctgaagaaaatacagatagcttgtaatggagatgaagcctctggatggtttccagggtgttattttccgacattgagtcttgtatatatcttgaatgtctataagcaaagaatggctatactgtttttaaaaagatatgttttatacttattaaccaatgtcctctctattcctctgcctttgaaaatagagctttgggggaaaataagtacctttggaaatatgttttcaaaaataatattcatcctgcttagatttagaagcacagattactctgccttagtttacttcattatttaccagagagattaactcaaaataaccttgagttaatgaaaagatgattaagtgaaattaaacccaaaagtaaaatgtctcctgagcaaatccatagaaagaagagccatcaagcatccagtgggccctccatcaagtgttgtttcaggccctcctttccaatccattctcattaccataattcacagtgtcagtgtctctcacccaaactaccaacacctcctcttaccgtcttcctgactccagttccagtgatcattccccaatcagcagcatcacacccacccctcacacatacatcatcatcatcatcattaccgttaataacacagacctgattttatttgaattggaaactacttggctttaaaaaaaaaaactcccttgcagctaggtgaggccatagaactcagccataaccaataagatataagtggagtaggattctaagataggctttgtaaaagggggcagacaactaaatgggcatggtctttcctgtccttctctcctacttctggattcccacctggaagttgattgtgatggtggaaataccaggcactggtcgggtgcgatggctcatgcctgtaatcccagcactttgggaggtcaaggtgagtagatcacctgaggtcaggggtttgagaccagcctgaccaacatggtgaaaccctgtctctactaaaaatacaaaaattagcctggcatggtgacacgcacctgtagtcccagctactcgggaggctgaggcaggagaatctcttgaactggggaggaggaggttgcaatgagccaagatcaggcacctgcactccagcctgggtgacagagtgagactctgtcccaaaacaaacaaacaaaaaatgaaatgccaggcaccagtttaggctcttgaggatataagttatgagccaaggatgatggtgtaaaaagtagcctaaatccctggtgactccatggagcccctgcctcagccctgaattacctaaccccagacttcatgacatgagaaagaaagaactttctgttttgctttagccatcattgtttctgttctgtttttagcaggagaatgtgattccttaccaatggaggggattcagttcctccaggtctggcaaccctgcagcttgggtccagtttcatccctcaacattgcggcctatgcagccagtgccccctctccctttctcccacccagctttcccatctgcaaccaagcttgttgcacaccatgtgccagacgcatggctgcacattcaaaatagaatgaaaagacacacaggcgatccctgccctttcagaagttacagcttaccgagttacagcttactgagttatggaacccacaagtatgtaattctaaaccctgataaatgctatgaaggacaaatatatgggtgtctggtttagtatggggaatgggagaggcatcactgaaaaagtagcatttgagatgagatttgaaggatgagtagagaccagcaagaaagtgggaaagataaaggataagagtaagactccagaaaagggtggaaatggagattaactttggaatttaattcaaacacacttgttaacatatcaaggattgtaatagtaattgcaaatgaatagcaataaatactgtcatagtccatttcaggctgctataacaaaaaaccttaaactcagtaatatataaacaatagaaatttatttataacagttctggaggctggaaagttcaagatcaaggcaccagcaggttcaatgtctggtgaaggcacagtctctgcttccaagatggtgccttgtttctgcatcctctagagaagaggaacactgtgtccacacatggctgaagagctggatggagaaaagggcccagctaattccctccagcccttttataagccactaatcccacttatgaggtcagagcccttatagcctaatcacctccaaaaggccccacctcataatattgttggattgaggattaactttcaacgtgaattttggggagaatacagtcaaaccatagcattcttcccctgacccctcaaaattcgtgtcctcatatacaaaattcatcccaaaatcgataacttattgcccaaattcttaacgtgttccagcattaactttaaagtctaagtctaaggtctcatttaaatatgatctatatcagatacagctgagactgaaggtacaagtcatcctaaggcacactcctccagctctgagcctatgaaatcaaacaagcgatgtgcttccaaaatacgatagtggtgcaggcataggatatacattcccattctgcaagggagaaatgggcaagaagaaagggtcacaggccccatggaattccaaaacccagcaaggcaaactgttaaatcttgaggcttgagaatggtcttgagtccatgttcatccttccgtacacactggggcaagggttggacatccaagggtcccacccgccctacccccatggctttgctgggcacagcccatgctgtagctctcacaagttggagtccagtgcctgtggctctcctaggctggcattgcacgctggtggctctaccagtttgggatctcagaggcaaccctgaccccacagctctgctgatcattgtcctagtagggaccgtctgcacctatctcacctttgtggcagttttctgtctgggctctgggctctccaagacatcttttgaaatctacgtggagacagccatgcctccacagctcatacactctatatacatgcagagttggcacttcaagaatgtcatcaaggcttattacttgtacctttcagaagggtggcccaggccacatctgagtccacttgagccccagctggggcagctaaaaagcactgtgttagaatgcggggagcaaagatctgaggaggccctaggcagtgaaacctgaggtgccatgggtgccctgggcccctcccttgaaacctttctgacttgaaggccctggtactctgggatcatgatgggagcggcagcctcaaagattgaaatgcctttggagtcattcttctattgtctggataaatagcatctggcttccttatagccacactaatctcatatcaaaagttacatttgcttagccacgcccttggtattctcttctgaacatgccctttgaatctttacaacctggcgaggctgaaaattttccagatctttaagttctgcttccctttttattgtaaattccatctttaattcatttctcttctcttgcattttatgataagcagtcaagaaaagccacatagtaccttgaacaatttgcttagatatttcttcaccaaatatcctagtatatcactcttaaattccaccctccacagagcactagaatgcggacacaatacagccaagttatttgccactttataacaaagatagcctttcctccagtttccagaacattttcatctgagacctcatcaaaatgacctttatcatccatatttctaacaacatttttattacaatcttttacgtaatctccaagaagactgaggctctgtctgtaactcttcatatgagcctttacgttttacagtccatttatggcaatctaggctttctctagcctactttgccaaactctttccgcctctacccattacccagttccaaagctgctcccacattttcaggtattcgctacagcagcaccccactactcattaccaatttctgttttagttcattccaggttgctataacaaaaaccttaagctggttactttataaacaatagaaatatatttctcatggttcttaagactgagaagtccaagatcaaatcaccagtaggttcagtatctggtcactgcttccaaggcaaaattaatccttattttattatcagcattccagtgaatagaaaaatcataggccaaatactaacaaattcaaggatgttttatcattagaaaatatgctaatataaatcacctcatcaacaaattttaaaaatgattatttcaatagctgcagaatatgttttgataaaattaaacgtgtttgtcattcaaaaaaaaaaaacctcttagctaactagtaatagaagggaatttacctaaattgacaaaaaaaaaatcaccaaaaacttgttatttagtggtgaaaagtcgtaggcattcaattgaaagagaagatcaagacaacctgtactttcaatcactgttgttgaagagaaatatctgtaaggacaaatcaaacctccttatggatatttctcttcaacatctaaacagtgattgaaaagggaaaaattaacttttagtttcagatgatataattgtatctaataaaaacacttaagtaagtctgcatatcaacaattagaataaagagaaatttctattaagttctgaaagacttttgtgaaaaaaattataaagctaaatttaaagatcctaaagaagaccaaaataaatgtatgctattccacattgatgtattggaagattcagtatacaataccttgaaaataaaatattcattcagaaatatccatgatacccaaatttatccttcaatacgatgtacgtctaatcaaaatctcaactggctttttatgaaacctaagatcctaaagtttatacgcaaagcaaacacaaatttccatgagtgattaaggaatgtccgtagattatgaacaaggttgatgagtatcatgtcaatattgttcatagggctatagaaattaagacattgagatattgacccagggacagacatagagaataataaatgaagcctataaacagacccacatagactccctcttgagtgacatgtgacaaaagatgtatggtggctcactggggaaagaaggtactcaatagatgggcctaagacaattgactacttatatgtaaaaacagtgaatttgtacctcccccttaagctttataagaacaactttgaattagtttacagcaaaagtgagaaacaaaacattacttaggaaaacatacaagacactatctgtatgaccacaggatggggaagcagttcttaaaacaatatataaagactagccataaagaaaaaaaaatcaatacggcaaacaacattaaactttagaacttccatatgatgatatacaacttaaaaacaagccatagcctaggggaattttcagtgcatacaaatgacagaagatggtaggcaaaatatattttcaaagtcctaccaatccatttgaaaaggacaaggcaaaaactgtacaaatgaaacaagaagctcaacggccaataagtgtaagaacgtaacacaagttccctaataatcatggaaagtcagttaaaaccaggaagcatcatttcataccagattagcaataatgaaaaaatctgacaataccagctgttatcaaatgctggcaaggggacctttagaggtgtaaattggtacaatcacttgggaaggcattttggccactcttgcaatgtctaaaatgtacattccctgcagtgcagtagacaaggttgcagaagggacatgtagtataccgccagtttatataaagtacgtaaaccaaaaaatcagatctatattgtatggatacatcacagtagtaaaatagcacagaaatgataaaaaataaattcagtaatatgtcaagggagggaaaagggggattgtgcaaagatcatcaaaggccaccaactttatctttgattctgttttccactaaaatgaaaaaaaaatacgcagcaaataatgaaagatgttaagatcagacagatatgctttggtggttcattagattattatccttttctgtatgctcagaagatttcataattcaatagagagggttcataggaagtaagaaagtgcagacaggaggtggaaactcattagagcagttttgtcctgaagagaaacaaagaaactggtagcagctggacctgtgcacagagggttatattccacagtgggtcattggaagcatgtttatatgttggttgagataactccatggatagtaagaaagtgtctacataatagagaaataagagaactccaggaactaagactttggaaagataagagttcataggtgttcgtttggagacagtagagccccccttgaatggtcattggagtaggaaccagggagaccaggtagaggcagaaatggaatcttcagtggtgcaaattgttccagggcagcatgttttagtaatgaagtatgaggctagatttgggtgggcagtagggaaaagacatgaacgttagaaaagattagagaaactataaaatcaacatcttggaaatcaggcaaacaaacttactgggagtgtgtactggaatctccatgctgtgttggacgaccagtcaaggctcatggtcatcaccctaaagtgaaccccatcagcatgtttgtgagattttctctaggaacattcagtagctcaggcacaggtgtggataacatggatgattgattccaaccaggaggtggtttccccagacaaacaggagagaggaacagaaaagtcgaggatgtctgtagggaggtgactttaaggatggtcacacaacgtaagctaacaaggaggacacagggacaaaaaggatcatggtttcaacagattggaggactagatgaggtccagaatctgaaagtttacttgtggtccaagatgtgttcgtgataataggggctgcagtggaattactgttgttcaacgagaggacgatcaccagcatcttagaggggtgatcagtatagatgtttaagtcagcagaaagaaacttcagtgaacgaagcaatgtgacacaggatgttcaacagacaatagccacaagcaaaatcattttatagatgttgaaaatgtggttcagagaatgaacctctacaaagcaaatcccaaactaataaccgaaggaacccgtgagtatttgaccccaaactccattctctttccagtaccaaactgcttatacaagtttcaacacagtaaactttaacaattatacaatggaattttatcttaatctccaataactcccctcaaaggagctggggatgacccttaaccagtatgactaatcagaaatatctggggaatattttcaacatacacaagccaaggctgatgctatacgtagtgaatcagagtctcccaggggtggggtccaggcctgtgatttcaaaaacattccccaggtgcatctgacgcacagcctgttcaagaaccagtggacttcagattattttcagtaccaaaactcacctgtttttaaagcacagatcattccaatagtcctgagaaagaactggaccaagagaacagactttagggcccagttgtatttacctggccatctctaatgtctggaattattgttttgtgtgccctatatagaaactcattccatcttggactgtattgagaagcatgtttttctattcagtatcttatgtaatcacaaaagagtcttagtgtttgcttactgtgctcaaagattcacttgtatcaatttattgataaaatacccacttttatcaatttgtttttataaagtgttttgcttgtcagtaatgtcgtctgcaaaattctcattgccagatgtattactttagggactacgtaaattatggggggtttctcgctctgtcactcacacaccttttctcttctgctaggatcagctttcacagctgtgtgcatgggggaagggccctctctgggatatgaactgaggaaggacgccccattgacctttgtttcctctctcctaccccaacctcccagctcaatcagcacagacatgattatgtaatcatgccaatataagagccacaattatgtttacttcacccttcccctacctctaggagataatatcatttcaactcacccagggaaatatatcagaattttggccaactgcagaaatagcctatataaatacactgctcccagaaaattctgccacaccttccagcctccaccaagtcaaacactgggtgagctggactgccttctatttcatcccctggattcttgtggggtggggtgtgtggacataatgtcagattcatccctatgtggtgacagtatcaatgaagttataaatatctaaggcttgtggcattccctagcgaagtgtctcacaatatacctttcatatatcaataactaacaggttttgagtatttcctgcttgccaggctctggtctaagaggtttaaaatgttaatgtatcgacctcttgaattaactgtctgtgctggggaatgttattacccccactttatggataagaacattgaggcacagagaggttgagtaaattcccccacgatgaaacagctaggaggcataattgggagacagacagtggcatagctggcttcggagactggctcttccccaacacctccatggtgcaccagggccagggttgacaaactttctccataaagggccagagagcaaatatgttaggctttgtgagccatacagtctctgttgcagctctagacaatatgtaaatgaattgtgttccaataacaatttatttacaaaaacagaccagatttggcctccaggtcatagtttgctgatccctgctctagcccagtggttctcaaatttgagcatgctttaaaatcatcagaaggactttctaaaatcagattggtgcccaacaacatcctgagtttctgattcggtgggctttggatggggcccacactttgcatctttagccgttcccaagtgatgctaatgctgtggatctaggaactactctttgagaaccactgcctaaaggaacattaacaaacacagcttgcaggttatcttctgaaagcaaatcaacgttaatgtaaaatcttaccattcctctaagtcatgatgacttagagactcctttgtctcgcagtctctggacaaagaccattttttatcttcttggtattcacagtgtctgagatggtggcttctgtgtcctaggtactcaaaaatggttgctcgtggaatgaaactcaaatgaatgactgtaatgctatgttaggtcgttcccattaattttaaaatgtgatgaaaatactcaggattggagtaaattgctctacctcagagaatgacattacctaatataggcaatttgtttgtatggtatagtaagtcatttttcccagttcacgcatttaaagagaatatacaccttaagatagccctgagtttttcccaagtcacattaaatgtagcctgccccaagttatgatcctacataagaagcagctcttgtttgtcaagatactgttccttagagatgaggtaaaaaagaagtcgtaggttatgggattttacagaaggcattaccagtcccggcaaaaccagttcttaaaaaaagattaggatcaggctgactggacacacctagatataacttgagcagaggatacctgccaggactgatttcccccttgggtaaacagccagatgcaaggcaatgcacaggccatttaaaatctcagtgctgtgactgaaccagagcctcgtggttcactttatttagaaaaacaggtgggaaattaaaaatcctccaaactattttgaattggaaaaagaaaacctcatttggtttcaaagcatgttttttttttttattttttatttttcctaactctgagaaaacgtgaacactgcagcgagtaaaaagactgctcactgccttccatatacacaaatcagggctttcctgcatccaaatgttactttgaactgacaaaacactcttggcactttaattttatttcataacgaaaaggcaaacttaacttctaagcatttttattccaagtttaatggcttacattcccggggtcagcaagcagatggagttggagacgagaatgtataattgcagattatgaaacagcaaaattaatgttactttgttaatgtcaagataggatttgagagctagaagggattttcaagatcattgatcctaaacctcatcatacagatgaagacactgaggctgaagtgattatgtgtcctgcccagctttgcaaagccagttggggacggagctgcatctgctgcctggtctcctggcaattaggccagtcctcccactgcagtatgccactatcctcatcagttccttacaagaaagaggctcgtatttatccttcactgctttacctttcagtgtagaagtgtgtgtgtgtgtgtgtgtgtgtgtgtgtgtgtaataaaggggagaagaagaagaagaaggagaaggagaaggagaaggagaaggagaaggagaaggagaaggaggagaagaaggagaaagaagagcgaagagccagaactgttggcttgcaaccatctgcaaatttcctagggatgtggctccttctgtctgtggctctgccattctcagtgggctgcccacatcgtcatggtccatgattaaccatcatcttgaaaattccagccaggagggaggagagaaaggagaagtggagtgcatacttttccccatacaaatgtgccctggatggcacacatgcacttccttggccagaacttacttgcattgacagacctagattgtgggtcaccatgcacccagctaaatatagtatatagtattatatccaatagaagaaacaatggtcactgagggctacctagaggtttcttagttgactccctggccatccaatatctgtgcttacctttcatctcacataaagaacacacgtattccccacctaagggaggcaatctctgtatatatcttattgctactgctttcaccttcaagttcatgatctgtacctgacacacactgttattcactgcatccaggcttcctcctctcagttgaacaactgtaaactaaaagacaagttttctgtccacccattggatccaatatagaatggtagagtaggaaaagaaacttcagtggcagacaaatggcagtggtggatccctgctaatgaaggcatgcttcccaagagttccagctgtaagagtgaagtcactccatctggtatcccctgggaaactctctggaaggagatcactaggagtgtgtggaagggtgtattagtccattttcacactgctataaagatactacctgagattgggtaatttataaacaaaagaggtttaattgactcacagttcctcatggctggggaggcctcaggaaacttacaatcatggtggaaggcaaaggcaaagcaaagcagcacgtcttacatgacagcaggagaaagagcgcttgcaggggaaactgccagacacttatcaaacaaccagatctcatgaggactccctcactatcatgagaacagcatggaggaaactgcccccatgagccaacacgtcccaccacgtccctccctcaacccatggggattacaattctagatgcgatttgaatggggacacagatccaagccatatcagagtgcattgctctggttcagctggggcacacagcctttgccactcacccccagcagggtggcctgactcacgcccagcagggtggtctgagtcaccaatcaagcttgtctggtggcttctttggcaacacaatttcctcaaaaacttagcaggcaactgtcatttaaacctgaagatttcgcttctttatttcctggcctctgggtactgccaaaagtcctctcgagttaatggtgtctcccttgggagtttcagtaacatagtctttgcgggaagtaaatccccttattctggtctctcattttttggcagaaaattccgtatgtgagaagacttagcaaaataggatcacacagttctatctcctccccttgcagtctatttggagccacctcttctcaccgtttcagttttggataaggtttggctttatcaaacttgcaaagtcccaagataactcatattcacttcaagttgactatgtgagccatgaggatgttcctgtcatgagaggatctaacttagcggagctctggttctctttcatttttgcttgatgtccagccgcctctagcataaattggcctctctcatgaggacttcgctgaaagtgtcaagtgtcaacaacaaaacatcaacattctgaattttctgatcatttcccctaatgttggtcatgccctgtgttcttcatcccaagatgctgcagatgacaatgtcattagatgctttgtccctgcataacaagggtcaccagctttctacccaccaaaatctgcatttttgctgtccactgtccagatgctttctctaagacaatgacatcagtgtggccagctggattctaacaaatgccacgcacaacattctcttccaaataccaaattctgccatatacattcagctgtgtatgagaatgatccaaatttgcagtgacctaaacacaaaatgagtttattgctttctcccataaacatctaatgtggtaactgtgctctacaaggtcatggggtgctcaggttccttctccttgtcattttaccacgccttggtgattttctggtttctatggcccaatatttctcagcaccatatctgcttttcagccaataggaggggagtgagatggttggtattatcatcttgcctattaagtaaggcacaatttggagatttcacgcatcacttcattcaatcccattattcggaatttaatctcaggaataaacttacttttttaggatgtcagagtccccagacaagggtttttattgctaaagaagtagaggaagtttatattgcagaacatgaacagtctctgctgcattatgtacatctttttaatgttcagcataaatatctagaacacaacctataattagtttaaagatgtaattcagcatggatatgctgtttacctctaaatctccttatctagaatattagtgaacctaccaaccaggaattcttgggaaatttcttatccaaacctttaaggttatctgatcttttgctgtcatttcattttcctctaactcttccaaaatgggcatccacacagaattctgtcagaccagcatttgatatccaaaatgatattaattaggtgaataagtctttatgtaactgttcaaactccacattttggatgtatctggtttaactcactattttaacttgcccattaagcttctattttcaatgaacataatttttattactagaatttacataatcttttggcaaaatgttgaacttattttctgttttctgttgtgtcattagtatctcaagcatgctaattttttagtcgttatcctattattctcatatctgaatctactgtgttttctgctaattttcgcacatcgtagcctgttctttttatgatttttaaaagtagattgtgagtttgtttgctctgtggggctttatgaaaatcctgagtgtcctggattaaaagtttccctttcctagaaggttctggacatttaggagtggtaccacgcggggataaatttttgttgttgttactttcctcctttgggggctcccaagtatagtcacatcaaactaaaaccttatgagagaaacacttattatcttaagggaagagttttttccaccaagatcccagaagacaatctctttgttatctatttgctggtgagtggatgttttacatgcctgttcaatagggctgactgtactgggatgggatgggatttcaccacatcatcatgcatgccccaaggacttatttcctctgacccctaaaatccatgcctatggtcgttggttaccaagaaaggcacaccctgtttccccctgctccccacctccaactcacccaacacaactgaatgaacatctattctttattttgtggccttgggaatttccttactttcttttgagcttagctatgtatttcaaagaagctgagtttatttttttctagcctttctaggtgttctgtagtagtatagtttcatattacttaactgtttccataaagaaaagtcagctccctaatttcatccatgaagttgcaaactgttacctacttcaacctaataaatcgcaatggaagcaacaggaaaacaatatttacaacatttgtgagggacaagtggtcagcatacttgtataacgtggcatatctggctatttaagctggattccagaggctcttcagtacaaacagtgactctacctctccttccccagcaactcactgtgttgcgcaaatctcagtaagagtttacactctctgctagccccagtaatagggaaggcaacgtggatgggaggcatgaaaaaggcaaagttcaaagaaggaggtctacatttgtgctcctgtattttaggcaagaccagaagatatggggggactcatgactttgaaagttcatgagaaactttatgagactcacaagccctaggagaaatgcttctaggcctaggaaatcagatatagtgtaaaattataaaaaagagcatattccctatttctggaagcctggaaaattcttttttttaagacagggtctcactggctcatccagactgaagtgcagtggtatttcacgactcaccatagcctcagctgcctgggctcaagcgattctcccacctcagcctttcaagtatctgggacacaggcatgccccaccacacccagccaatttttaaaattatttgtagagatgaggctggtctcaaattcccgggctcaagcgatcctcccgcctcagcctcccaaagtgcggggattacagatgtgagtcactgcatgcagtgtggaaaattcttgcaacattagaacaggcatggcagagtttatgggattggcaccactctttttccacccaagagacgatagtttttctgttgacttcctcagggtattcttgactgttggtggcagcagtgtggcttcccaatactgtgtcttgacagtagacaggggcaagtgggagccagcgctagacgcgcagaggaaggcagacagcaggtgggatgggagctcaccaactgggctcgttggctcgtgtgaagcactcctttggggactcccagaagtaactcagagaaaatgctttgtagggagctaatttttagcaatcaggctaggggtcactgagctcccataattgattgagtctctaaagttaaggggactttatactggcaagatatgggtagaccatgtgagtgctgctaaacatataaagagagttcaagtgatgggcatttagggtgattccataaagaaaatgtggcatatatacaccatggaatactatacagccacaaaaaaatgagaccatgtcctttgcaggaacatggatggagctggaggccattatccttagcaaactaacttaggaacagaaaaccaaataccacatattctcatttataagtgggagctaaatgatgagaacacatggacacatagaggggagcaacacacacttgggcctatcagagggtggggaatgggaggagggagaggatcaggaagaataactaatggatactaggcttaatacctgtgtgacaaaataatctgtacaacaaacccccatgacacaagtttgcctatgtaacagacctgcacatgtacccctgaacttggaagtaaaaagaaaaaagaatgcttaagaaaaagacagtctcaaacaaaagatgaatgaaagacaactcataaaaagagaaatgaaatagatttcacatataaaaagaaattttactaaaaaatttaaaaataaattaacgatattatttccatttaccaaactgacagagattattatgtgtttgccctcttatttctctgactgatgggcatgtaaacttgtataaatgtgacaaagaaaaatacttcacaagagcttttaaaacatgcagaccaggccggacatgacggctcacgcctgtaatcccagcactttgggaggccaaggcgggtggatcacgaggtcaggagatcgagaccatcctggctaacacagtgaaaccccctctctactaaaaatacaaaaaattagccgggcatggtagcgggcacctgtaatcccagctactcaggaggctgaggcaggagaatggcgtgaaccagggaggcggagcttgcagtgagccgagatcgcgccactgcactccagcctgggcgacagagaaagactccgtctcaaaaaaacaaacaaacaaacaaacaaacaaaacaaacaaacaaacaaaaccgtgcagaccatttcactccaaattaatttaaagaaataataaaagaggtttgcaaaagttggggacagagattgccagtatgaggctctcatattggtaaaaagatggaagcaacataaatacctcacaataaaagaataatcaaatgaattttctatagctataatgaagcctgttgaatcttatggccttttcaatgcctatttcaacacatggaaacttgtttatgagatactcataaaaatttttataatgtaattacattatgacataggtgagtagcacaggttgtaaaacagtatgtatgggatataatcctaattttgtatatttatacaagtatgcactgaaaaactggaagtttgtacagtcatccctcattatccatggaggattggttctgggactccctatggatatcaaaatccatggaggctcaagtctcttattaaaatgtagcacttgaatataatctacacatatcctactatgtactttaaatcatctgtagattaaatcatctgtaatacaatgccaatgctacataaacggttgttatactatgttgttaagggaataatgacaagaaaaagtctgtgaatgttcagtacagatgcaactctccattttttaacaacatttaaaaacccacaggtatggaggactgacagcacacagataagtggttatcacgttcttcattctgaatttctccactacatttttttttcacaataagcatgagctgtctctatattcaacaaaaaaaagaataaatgctattgttatggtcatattgtcttcatcaattggcttttcgtgcccctagagttttactcccattgtttctgatgcacagatctggagagaagctcaagagaaggaaggctccctcttcccactctgagctcctacaaccagggctggcccctcacagctgctgccaaagaggatctccagagacccagttggcttttgcttggaggcccccatttatggttgggacgttcccttagttaactgttcccctacattgaggactcacgtttctcattttttttgtttttctctttgctttgttttgaatgatccctttctggattattctgctggttagcaatttcatcactcactccccataccgagttgcctacgcatattgggttaaaccagagaaaagtgttttctatggaagttaaaaaaaaaacgtaaataatagcactttgatctcatttaacctatttctatgatacctaagttatcccatcaaagtggaaaacatttcatttttctgattagaaattctggttaactggttgccccacatgggtagtggtgccaggcagagctacaaggaccctgagcaatactttcacatgagcaggaattggttgatttttacttcagtatttttcgaatattgctttctcactaatctaagctatcaacttggaggatcaggttagagtattgacattgaaataagcttcatatatataaaaaagaacagtttcctcctggattcaatttaaaggaataagcaagaaaagaaaaaaatagataactctcacaaaatttaataaattgattggatttgtgagatatttttaaataaaatttaattcaaaatgttgaaactacagatgactggaaataatgtaaaaatagaaatccaattttaaaatacatatttcatgttggagtagaagaaacgtgcatctcaacttattcctaaagttctcaaagtagaagaataaaataaaatgtaatctagaaataaaagtagaaacctttcagcagctcttgggcaatgattagtaaatgggtcaagtaattactatttaatgtaattgtcattttctttgtaatagtttattgcctttaaccttggtttaagaaatgagattctgttggtatgaaagtaatgatatgagtattcctcaggcaggtagttggatgcacatatctgaaattcaagagagtggatatgggagtcctccattcacagatgatgagtctggatgagaacttagagtgagaagaaccaagtgcaagaattgagttcctgagctcagaattcagggaaaaaagagaaaccagtaatgaattcatgagtgcccaatgagacaagaggaaaactaggagagctcagtgtagggaagccaggagcaggaatatgtctaggaagaggcagaaatcaaccccattaatgctgccaaaaaaggcagctacatagagaattgcccattggatctaactatgccaaggtcactggggaccttaacaagggcagcttttgtggagtcatgaggctgagacaaggtgagacagtagtgagtctgagagaagtggagaatggagaataagcttttttattttttttatttttttaagttttgctgcaaagaataatggtggtggcttgaatcctaacatttcaactcaaaccaagagcaaaatgaggaccacttatctaaatatttaaaatgtaagtgaaactaacaaattgtttcagaaaagatgctctatcttcataccttgggaaaacatacttttgatgtaagatgtttccacaggaagaaagtggcagaaaagtatctgggatctctctgaagattttcttacaactgcgtgtaaatctacaattgtctcaaaatgtacctcaaaaattatcattacaattatctcaaaagttaaaaactgttacctttgttaataacctggaagtacaggcttgagtttagacattagaattcctcagagttctgcttcagaacccggagaaaggactatctgtagaattttcagggcccagtgaaatgaaaatatggggcccctggttcaaaaatgatgaagaatttcaagatgttaacagccagacattaaaccaaatgtggagaccatgtgaacccaagaccccgtctgactgcacaggatgcatggtctccttctagcaggtgtttgcacttgtgtggtttgaacttctccctggcaccatcatcttgcccgcctgtgaggcagaaagagagggaaggtgtaagttgaaagctgtcagaggtcaaacatcaaaaatagagacagattcttgatgacacacttgcatccttcaagtctttgttcataaaccgctgtctcaatgacacctacttgattatctgatttaagatgtcgccccctctcctcacatgcccattactgatctatattttttttccagagcatgtatcaccttctaacaaaatgcatactttattttattgtgattattgttgatctcctctcactactaagttaacaccataaggacagggatttttgtcttttttgtactgaaaaccatgacaagcccatatttagtgcccaataatatagcaaataaatgtatggttggggaaacttagggtccaataaatcagccttaatgtgagggttccctggaaaaaattccccaactacagaatatctgtctcctcttgaatgtgactcccaaatgacacagtggcacactcttgtttcctctttaagatgcaaacattacaaaggcttcacatcattcaactctagggttgagtttgccttttattgcttttggacataagaccacagaccaaagcaagaatagtggagatgtcgcctttaaaatataaaactgaaaacagcaaaagttagagagtgactgagtaggagaataggcaacattttaaagttgattttacaaaggcagtcatcagacagcactgtgtcattttaactcaagattctcaagtggctctcatgctgattgttaaagcaggagaatgattggccctaagatgatgtactcctcccaggaatctgaaattcatagatcatctggaaggaccagagtgcttgtggagtgatgggggatggggtagattattatgagaaagaagagggctcctcaaaggaaaaatgcaaaaaggagactgtaagacagaggcatcaaaagcagatttcatcacttccccagggctcctgagcgcgagagggaattgtctgagtctaattaagaagcatggactttggatcttattgcaggttatggataaaatcagtctcatatcaagtcgtcttgcttctggtgcctgtgtttattaagcttcaggaatagaggaaaagccgaaaggctccttccaggagccctgccttttgtgttatctctgctctttatgatcaacgtgaggaagctctacctacacctccacagcacttaaccgtgtctctttgattagttgggttccaaaccaagattgtgtctcacttttgggccttctcatggctgcctgctggagtaagataatgaagtaaaaagaagttggacaaaagaaaagaaaaaaaataaaaagtttacctgttttagtcctacactttccagtactccatggaaaattccatctcttcatttgatggtctcgattctagaattcaaatgttgccccatcacttttccccagcttgccccccactctggatgtgggatgtggctgaatctcaattattacacaaaatggaaatggaggcacatcagagatttattgtttcaaccttggagactgaaatatattaaaataaatggcaaaaatcatgaatctttgcttgaaaatgcttgtgagttttcaccttgggaattcaaggttacataactagataattacgctttgcataatatgtcaatctttgggcttccgtatcagtcacaacattagcaaaagaagaaaatcttcagcagtctatacccagctgctaccgtggaaacatcccaaagtctaattaagagtttgaaaaaatagttgtaacactccccgaagaactcatctgcattccaacagtattgagaagagtgataatagaattccaccatgtagttaatattagtaagtccaggaaaggattaaagaacaaacattttgaccagagcatagggagatttgacaatttttgcccagaaggactgatgtgacagccgtgtgtggctcctcccattcttcatctgtacaaatggaagagtttattgtgtcactgttcttcaaagataactttcattattgttgtttgcttttgttgttgctgttcataagtcttcagatcaagaagtgtcagatggagagactacagaaaacactgacctttgattgacagtgattaggcggtgttttcttccactagagcatgagatacgtcacacagagggagagaaatgaagatgtatggccaagagggtgcactgggataacttgttttgtcaactcttggctctctcttcctggaagaagattctccctccccttcttcacatggtcagactggacaaggagacttgctttggctagcagtgtgagctgacaaggtatgtacactgcatctgagcagatgctttaagaacgttggtgtgggccgggcgcggtggcttatgcctgtaattccgacatttagggaggctgaggcgggcggatcacgaggtcaggagataaagaccatcctggccaatatggtgaaaacctgtctctactaaatgtacaaaaattagctgggtgtggctgcatgcctgtagttccagctactccagaggctgaggctccagtgagcccagatcatgccactgccctccagcctgggctacagagtgagactccatctaaaaaaaaaaaaactttggtatgtttgtctcacctctgaggctccttgcctttggccatgatcaggacatgtctcaagtaggggctgctccttcagcttttatcctgaataaagtttcatgaagccaacccacagggaatgtaaaatgtgaatgagaaataaaccagagatttgagggttgagggttgtttggaactgtagcaaaataaatatagtgaaaactgacagattctggaattacctatatagttgagtacctgcacaacaagagtaaagcaatgttgtgcctagaaagcatcaggtcaatatggccaaaggtttctttgtcaaagtttaaaagatctgagaaggccaggtgatgtggctcatgcctgtcatcccagcactttgagagaccaaagtgggaggatcacttgaggccaagagtttgagactagcttgggtaacataatgagaccccatctctacaaaaattaaaaatcagctggtcatggttgtgcacaactgtagtcctagctactggagaggctgaggctggaggatcacatgaggccaggagtttgaggttacagtgagctatgattgcacaccacaccccagccacagcaacctagtgagaccctgtctcaaaaaaaaaaagaaaaagaagtttgaaaaacaaagggttggcagcatataaacaaaacatctagactctcttgggtagtctagactgaaacgtagactgaaatgatgatgtggcctgccctactgtttggctgtaatcaccgtgccaaaagaatttgtagtgcttttgaatttaggaaaattctggcaagtaggacttacttgcattctatgtaactatactgtgtgctgaatatgattttctcagggagtaatcaaaacagatttctttgaagatgaagcaaagttcagaggttttgttacctgaatatctgtacatttagaatgggatgtctagccgtaactgattcgaaggttatttgatttctctcctgctttatgtaagttagttttagaggggggtagacagattgctattctctgttccattcctcttgttatccccaaacaaaaatattaaggcctcaacattcctttttaaaaaatcaacattaaagctcacacattcaaagtcatttgtataaattacatggaaagctgttgccctcccacaatcggtgggctctaaacagaagtctgacacagcttgtcagtgttcttgttggggcatcaataaccttggcctttgggaaggagagatggatgaagacggatgggtggtggactccgccagtcaggtctctccactgccaatcatggacaccagcacattcactagaggcagagctactcaaatgcaattaccagatgccgccgccagaacaactgttcctcatctcactcagagccattgctctggcttttctgctacctcttaatcattttaataatgtgacgtgctgctttttctttgtttggtgtatgctgcagtgacaatattttccaaagaatgattcataatgtgttagaattcatagtttacatgtgcctgtcaaccatttgtaatgcaggtgtttagaaagttagcatatttgagtagagccctgatagtgaaagaggcatgtttgaatgtacgtaaagtcaataggaaaaatttaggcacacatatgccttagctttctttaaatataaatactttatatttccttaaataaaatataaacctaccatacattaatttatttgagtggtttctgctctctgtatattttcaacttatacttctgctttattaggacaatgctagctgctgtaacaaataagtccaacactttggttgtttaatataatgcagtttttgttgttgttgttcatggatcatgtaagagtccagtgagaaattcctggaaagtagtcagttttcctttaactcgtgactcagagatcctaaagccttccatcttgtggctccactatgccctgggtgctatagtagaccctcaaagtcttcttcctctaaccagcagaaggacaaaaagacagcaaaaaaaaaaaaaaaaaaaaaaaaaaaaaaaaaaaaagcatatctgcttcttaaataccccagctcagaagtgacacacatatcactcccactcatatcacattgaagataattggatatggccagacttaaatgtaaagttgaggtggaaaatgttgtcctaagttgggaaaccacctaccaaaaccatctctatattatggaagaaagagtaccattttttgttggatagttctctgtctgtgccacaaacaccttgtgcgataataagtttttgctcgtatattttaaaacacaggacttctttttatgtcaatgttatgtcaattctatttcaaaattcaaggggtaacttttacatacatcactggatgactaacattctgcttccatctttctgtacaaacaatttgtattctagttctcaaagcattgttatgtaatgcttgctgattcatattcacttaaacagggttcatatggagagtttcacacccatgatttggggttgaggacaaacataacaacatgtacctcacacactcttcgcttacataccataaaaccattaatactatgaccccagagacttactccccagaaagaatccaagtaatttctaattctcccccattattcatttactcattcagaaatactcattaatttcctgctagatgccaggcatgaagtctcattttacattcttcagccagtgtaaaatattccatgtaactacctataatttttaatgtcaattcattaagaactttccaaagggaaatgcatcatattacctgattctgcacctcttccctgtaacatgtccacctgcttattctttttctcaaaatgctctggcttcttactgctcagccgggaagccattctcccacagtgcttatgtactaaagtgtaaacgctgagctgcttttactggcgtggagcagtggctcacagtttcggagaccatactcttcacctcccttccccaactccttcttgtgccttccactcacctggggaatccatcagccctttagctctttagcggaaaaagccactttgctgaacaaaagtctgtctctcaccactccttgatcatcccatgaggtcccatcccagaaagtctcactttgaggaacaaggaaagaagtccatactaaggacttggtaataaagttagattggttttcaactttgttttgttctattttattttcaaccaaaatgaaggagaactcaattgaattgtcagctgatagatcgttaaaagcaatttttgatgataaaatgtagtatgatttctggagtatagtttggaaagtattcaaagaattgagtggcattgttataacaatctgactctatttccatctatttatgtggatgaattttctaagtagttgaacttataaaactgagaaataggaatagaattgatgttaaatcttttttcactttagcaataagtaatatttatatggggacatatgaactaaaagaaaaaagaataaaaaggaaaaggaagaaaatagaagaaaaaatccctcttgctaaggatgcatttttcaataaaatgttatgttctttcatataattataaaaatttgtgagacatttttatttttgttttattgtaccatggtaattattgcaatgataactaaatccacaattattcaaaatatagaccagagtatttaaaatatcacatattttagaaaattaaatatgaatacatactcatatttatattgtagagaagtataatggaaatgcagatttaatgactgaaacaaattttgtgaaacttctcctatgaaagaagagtttgttcaggtagtttaaaaatagtgaatagtagatatcaaattactttggaatttagattttattggatatatttacagaagaaaatataaaggttttacttaaaatttccagtgtttgtaagacattaaaacttaaagacttacatgttagaactaaaaccataaaaaccctagaagaaaacctaggcaataccattcaggacataggcatgggcaagagcttcatgtctaaaacaccaaaagcaatggcaacaaaagctaaaattgacaaatggaatctaattaaactcaagagcttctgcacagcaaaagaaactaccatcagagtgaacaggcaacctacagaatgggagaaaatttttgcaacctactcatctgacaaagggctaatatccagaatctacaatgaacttaaacaaatttacaagaaaaaaacaaccccatcaaaaagtgcgcgaagtatatgaacagacacttctcaaaagaagacatttatgcagccaaaaaacacatgaaaaaatgctcatcatcactggctatcagagaaatgcaaatcaaaaccacaatgagataccatctcacaccagttagaatggcaatcattaaaaagtcaggaaacaacagatgctggaaaggatgtggagaaataggaacacttttacactgttggtgggagtgtaaactagttcaaccattgtggaagtcggtgtggtgattcctcagggatctagaactagaaataccatttgacccagccatcccattactgggtatatacccaaaggattataaatcatgctgctataaagacacatgcacacgtatgtttattgcggcactattcacaatagcaaagacttggaaccaacccaaatgtccaacaatgatagactggattaagaaaatgtggcacatatacaccatggaatactatgcagccataaaaaacgatgagttcatgtcctttgtagggacgtggatgaagctggaaaccatcattctcagcaaactatcgcaaggacaaaaaaccaaacactgcatgttctcactcataggtgggaactgaacaatgagaacacatggacacaggaaggggaacatcacacaccggggactgttgtggggtggggggaagggggagggatagcattaggagatatacctaatgctaaatgacgagttaatgggtgcagcacaccaacatggcacgtgtatacatatataacaaacctgcatgttgtgcatatttaccctaagacttaaagtataataataataaaattttttaaaaaagttaatctggcacagattgtctgaaccacaaaaaaaaatttatatccttgtaattatttaaatttatgataaaacattttggatattaacctaaaatgtgagaagggatatatagtttttcaacatccttttgggaaaagtatttgaatatttctatcatggtgttagtgtacatccacatttgcatgcaccagattgaactagaagcagacagtatgctcacatccaggtcttctccctcttacctgaacaccttggggttggagacatatctaacttcacaaaggtaatatgatgcctataccatacagtacgtaaagacctgtggtgggttaaaatgatcacaaatcctttgctacttctctttttgagagatggggtctattctccttgtcctgaagtctgggctggactgtgacttggccactaaaaggcagtgtaagtgacatggtaacctttgagtctgggccttaggaaagctgcagctttacttcaatcttcttggagttcaacctcttaaaatccaaaagccttgctgaagaagtccaaatgagttgcacggagaaggctcatggaaaataactgacatagccaaaggcccagctcagccctacctgacagccagcaccaactgccagccatgtgagtgagctgagccacctctggcatccccagctcaagggaacctccagctgactgcaacccccagctgatactaggaggaacagaagaaccacccagctaagcccatcaacccttagaatcatgagataataaatggctgctgttagtttaagctgtatgatttggtgtagctcattacatagcaatagataattggcattttccaccaatggagtctaggacagcattatgaatttgaatctgaaccttagagcccagatgaaatctgttctccagaatggagtcactaataacacccatcagaggttccctgtaaccttataaccatcactgcacactcagaggcacctttcattggctttttgtatcttttcttgttgccacattagctcataagctccctgaaggcagggaaatattcttcttctctatctgtctggaagtcccaacctttgggctttgcacccaaacacacccacaaggtgaaaacttgccatcctcaagtattcttctatctcatcttagtgtattatatatgtctacaattacccctcttttgtagatatggaaactgatgcccagagatgtcaagatgtttctcaaagtcacacagctaataaatggaaatgcttggatttgaacatgggtaggtgagctttggagcactacaaatgctgtctatattttgaataaccatcagctgagctgcctaattcagccagtaagcatttcttaggtgacaggaggttatatatgaactggtacctttcttcctacaaaatttgatacatttagcaaatgtttagagaccagcaaaatactgtattagttacccaaagtgatacaaagatgattgactattcatggaaatcactcagaagtcaaatatacaggtataaaaatgtatactgctcacacaatttgcatttgcaaaaatgtgaaaccagtccaaatgcccatcaatcaacaagtggttaaagaaactgtggtgtgtatataatacacacacacacacacacacacacacacacacacacacacacaatgggctacttctcagccataaaaaggaatgaattaatggcattcacagcaacctgaatgggattggagactattattctaagtgaagtaactcaggaatggaaaaccaaacatcgtgtgttctcactcataagtggaagctaagctgtgatgatgcaaaggcataagtaggatacaatggactttgcagactcaggggaaagggtgagaagtgggtgagacataaaagactacaaattgagttcagtgtatacagctcaggtgatgggtgcacccaaaatctcacaaatcaacgctaaggaacttattcatataaccaaataccacctgttccccaaaaacctatggaaataaaaatttttttaaaaaaacaattattgcaataaaacaagtcacatatacacacacatagtaagtatatatatatatatatatacactgtgtatatatatctacacacatatatatacagtatatatatatacactgtatatatatatctacacatatatatacagtgtatatatatacatataatagtgaattaataaactactagttcgatctccctggctcatttgtcaaggagcttacaatctctcttattaagaaaacacatattcattaaagcaggtgctcttataaaaagaggtacagccaaataagaccacaaggtaaaagaaatacaagctttaataacaatctaattatgcccaaatgatgcttaccagatacaagctttacttaaatctttttccccccttttcacttaaccgttgtggacaccttagaccttctcaacagtcccctttcttccagggccaagtccttcccaactccaagcccctcacaattctagggttcctccctgccccccttcattcttcctgctattcatgtgtttgcttcaccaaaagtcttcatcctgcactggtcattggccctgtgtcctcctcttctttgaaatgtactgattttaaaacttcccctcttggtgagaagttttctattttatagccctgccttttccagaaaccagatgccttttctcctgaatatttggaagtctgcaaaagcaaccaaattcatttaaagtgacacctgagaggatgaattcctgaaaggtgcatttaatcaaggttaaccagtttgccatggcctgaaattacgacatgtcatgttagaaagatgtacaatttggcaacattttcaaagtctgtaggttttgaacctacagtaaaccattgacctccctattttaggggcaaacacttttgaagagaatctgcattccacttgctaaaccatataaaacaaggtggaagagaaaaaagattcaattaaacatcacttggggatttcaaagaaaagatattaatctgtcttctcataaaactcttcacccacaattgtgatgaatttgaatgattagtaataatctctcagacttaaaaaaaacagacagctggatcattgaatttgaaaaataatcctttgctatttacatagaaatcgttagaggctgagtttttaggtttatagttttacagtaataaaattattttttttaaattagccaggtgtgatagttgtgcacatttagtcccagctactcaggagactgaggcaggaagattgcttgagcccaagagttcaaggttgcagtaagctatgattgtatcacccagcctggagaacagagtaagactctgtctctaaaagtaataaaataaggctgggtgtggtggctcacacctgtaatcccagcactttgggaggctgaggtgggtggatcatgaggtcaagagatcgagaccatcctggccaacatggtgaaaccccatctctactaaaaatacaaaaattagccaggtgcggtggtgggtgcctgtagtcccagctactcgggaggctgaggcaggagaatcgcttgaacctgggaggcggaggttgcagtgagccaagattgtaccactgcactccagcctggcgacagagtgagaatccgtctcaaataataataataataataaaataaaataaatataaatataaacaaggttaatatttgtatttataacatagaattatatataaatacccagtttgccatttaaatagttaacatctagggcattgtagaatatgcatatttaggttcatacagaggctatgtatttaggtagtattgttgacaaaatatcaacaatattgccctaaaagactgcttctgaaattagaaaagcttcacattttaaaagaaatgcaaatatttgtctatttgctgctcactttcgctgtatcacaaaacacctgaagggctacttgccttcggattttcttatcttaatggtaaacagtgttgacgatgaaaatcacacagcactttgctgcaaatctgagtttttatgtgtagtggataaatggcacatccgtgcccagtgctatgaattgctcctctgaaatcatgactcaaagagggcctggaaagatgaataactgtccactcctggacaatcatctccaccgctgctctgaggtcaggtaacagcagggggcttatgtcttctcacttgcttagggacatgaagtccatccctgcaacatagtctccctgacaaagcttcccaggaaattaaggtctctttgtaacttgttatctattagaggtaactgtctgcatttctgaaaactgatcagctcctaaaggcctaagagcgtagccacttgccctttgctcttggcccccactgacactattctgaggatataggctcaacttaagtggaccttgataaggcaagcatgaattgctgcaggcttgtgcacacaggatgtggcccactcacattaggtggcccattctgtggttgttctaaactcaaggtcagtaatgatcataaataaattgcaccaaagtgccggaggatgaaggacaagattgcttcacaggctggagattagagctattgtagcttgatgaagtagccagtggtccccacacttcctggacagctagcttattaggaataagtctttgtcatcaaattgcagagaagactgcaaactcctcttactggttttatgagtaactgtacccgagggaggcttgcatgactgtctggtaaactccaggctgggaaccatttgtgaatatggttgcagaggatttcagtgtgaataagaccaggtgcctgaaaagctagattttaatagaatgatacaatcaataatattaccatttaacatgttgtatcagttagaattgggcagttgcatggaagagaaggcccaaacagtgctttatccaaaatagaaatatatttgttgcacctgtaaaagcagagtcccaagaaaggcatcaagggagtgtgtggacctgctttcctaagtctgcaggacacaggatctgtccagctcataccgcttctgttcccagaatgtgtctcgtgacctcagtgtccaggcaggatgtcagagctccagccatcgcagccatggtccagggaggaagaaggtggccctcttccattcagagacactttctgggaattgcatgaagcacttgtacttacatttcatgggccgaaacacatggtcacatctgggttcaagagacatacgcaagcagtcatttggtttgatgccaaagagactagaaaaaaagaactggggtcttattactaagaaaaagtaggaaagtgtatattgggaggcgggggcaagtaggagcttctgctacatataattataacctcttaccgtgtaaatgactttccattaggggctactttttaaaaacaaaattttctcttttaaagctgtcatattatttaaacctagaaacaaaataaatgaacaatgcttgcctgctcatgatgatgatgtagagaattatattctggctagaaattatttgaaatccaataaactgtactaattatatattaactcatcaagttcctaaagaactttgatattgtaaagtaccacagaattaaaatataattctcactaagctagattgagatttttttattgaaatttactttgctaaaaataaaataacagcaaaaagtctataagagaagattgtactcatcagtccagaagttctaaaactaaaatccctaaagctttttaaagtattaggattctagtcatagaattaaaccatttattctcttgaaaaaagggttacaatgacctctccagtgtcctcccctcaagacacacacacacattaaaatttatattttgaattctaaatctggttgctacgacaactacaaaaacgacactcactttcattggggcatgctggttccatttgtttttaaagaaaagggtgtattttgctccctgtgagacagaaatgatggatggagtctgagcctagaggtcagaagactggtttctattctcagcttccagcattgatttgtgtggctgcaggctagttacttaaagtctttggttttacatccactatgtacaaaacttattttcctttgatatgtacccttcataagtggtaggtgttaactggggaatttaccatgaaaacccttgagattctcccattctggtactgcccaacctaatttccctaaacaggtaactttttttcttttttctttttagtttaattttatttattttattttattattattataagttttagggtacatgtgcacaatgtgcaggttagttacatatgtatacatgtgccatgctggtgcgctgcacccactaactcgtcatctagcattaggtatatctcccaatgctatccctcccccctccccccacctcacaacagtccccagagtgtgatgttccccttcctgtgtccatgtgttctcattgttcaattcccacctatgagtgagaataagcggtgtttggttttttgttcttacgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttataatcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctttccagcacctgttgtttcctgaatttaatgattgccattctaactggtgtgagatggtatctcattgtggttttgatttgcatttctctgatggccagtgatggtgagcactttttcatgtgttttttggctgcataaatgtcttcttttgagaagcatctgttcatgtccttcgcccactttttgatggggttgtttgttttttcttgtaaatttgtttaagttcattgtagattctggatattagccctttgtcagatgagtaggttgcgaaaattttctcccattttgtaggttgcctgttcactctgatggtagtttcttttgctgtgcagaagctcttgagtttaattagatcccatttgtcaattttggcttttgttgccattgcttttggtgttttagacatgaagtccttgcccatgcctatgtcctgaatggtaatgcctaggttttcttctagggtttttatggttttaggtctaacgtttaagtctttaatccatcttgaattgatttttgtataaggtgtaaggaagggatccagtttcagctttctacatatggctagccagttttcccagtaccatttattaaatagggaatcctttccccattgcttgtttttctcaggtttgtcaaagatcagatagttgtagatatgcggtgttatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggtgatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtatcctcttttatttcattgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagacaatggggttttctagatatacaatcatgtcgtctgcaaacagggacaatttgacttcctcttttcctaattgaataccctttatttccttctcttacctgattgccctggccagaacttccaacactatgttgaatgggagtggtgagagagggcatccctgtcttgtgccagttttcaaagggaatgcttccagtttttgcccattccgtatgatattggctgtgggtttgtcatagatagctcttattattttgagatacgtcccatcaatacctaatttattgagagtttttagcatgaagggctgttgaattttgtcaaaggccttttctgcatctattgagataatcatgtggtttttgtctttggttctgtttatatgctggattacatttattgatttgcgtatattgaaccagccttgtatcccagggatgaagcccacttgatcatgatggataagctttttgatgtgctgctggattcggtttgccagtattttattgaggatttttgcatcaatgttcatcaaggatattggtctaaaattctcttttttggttgtgtctttgcccggctttggtatcaggatgatgctggcctcataaaatgagttagggaggattccctctttttctattgattggaatagtttcagaaggaatggtaccagttcctccttgtacctctggtagaattcggctgtcaatccatctggtcctggactctttttggttggtaagctattgattattgccacaatttcagatcctgttgttggtctattcagagattcaacttcttcctggtttagtcttgggagagtgtatgtgtcaaggaatttatccatttcttctagattttctagtttatttgcgtagaggtgtttgtagtattctctgatgatagtttgtatttctgtgggatccgtggtgatatcccctttatcattttttattgcgtctatttgattcttctctctttttttctttattagtcttgctagcggtctatcaattttgttgatcctttcaaaaaaccagctcctgggttcattaattttttgaagggttttttgtgtctctttttccttcagttctgctctgattttagttatttcttgccttctgctagcttttgaatgcctacacaggtaattcttctgcattacacaatcaagtgtactctgtgtagccactaaacttcaagaaattgtttggattcagatgtacttaaatgataagaaacccatttataacccattcacaggcagggcctggggaggcaggtttctctaaacactttgcataaaattagacaagaccaagagagtttagacaaagctcaggctggttccatttcaaatctcagatccagtggacatgtgaatgaatacctgggattatgtgtttctggcatagaccaggcaatttcacctgccacacaactgtgcctaatgaatgctttcttctcactccgaatggatcttctgccacatctaaacacatggtatgattgtcagttgttctgttaccataaagttctgagacaaaacttcccatgtcaaaataaatcagtctgctaagaattttttggttcatctggaaaccttgggactgcctatatttccaggactatttaaaaatattttaaaaggtctgccaaaaaatgggaatatatgaagaatcagcatgataactagtttgaacacattttttatgaagcaaaccacagaatgcttcacagagttaataaaaacatgagtcctcagaactctttatgacatttgagactaaaattggcttcactttaaatcacagactttagagtcaggcagacctaggtataaatcttctatttaccttttacttgttgtgagatttttggcaaatgacttaacctctctgagcctcagctttctcatctgtgaaacggaaatgtctgcttcccagggttatgggggttaaagaatgaaactgtgaagaatgcaactagacttcaacatcagtcactcccaaggttctttcctttctgtttagaagtcacctctgtggaaaaagaaggcagatcctacacaggtgatgggattttatgctcaacctggacaactttcaatccttccttcttatttgtgtgcaagtaataaaattaaaaaagcttgagttccataatcaacacaaaacctcataaagcccagaccaagccattttctttcattctttgcgttctttctttctgctcatttgggaacatctttatcttgtagacacttcaagaaaatgacaggcaaccatggctagtgtggggacacaggactctgtaaagcgggagaaaagattccaagggtgccgttagcctagttctttctgccccttcagtaaaacagtgtcaacaacccttgcattcctgcagcttcaggacagcatcccgtgctcagaaggttccctggacttcccgtcctcccaagcaagttgaaacttttgtctttgttcatcagtgttagtgagtatagtctaaggaaggtagcacattagctgcctttgctttctttctccatcccttggtatcctgaggcgcataaggatttaagagttgctgggcacggtggttcaggcctgtaatctcagcactttgggaggctgaggcgggtggatcacctgaggtcaggagttggagaccagcctggccaatatggcaaaaccctgtctctaccaaaaatacaaaagttagctgggtgtggtggcgagaggctgtaatcccagctactcaggaggctgaggcaggagaatcacttgaacccagaaggtggaggttgcagtgagccaacatcgcaccactaaacttccagcctggtgacaagagcaagactccatctccaagggggaaaaaaagtcaactaacacagttctgggagctccatgacactgagtttaagcaaagtagaggagcccattgtagcctactctgaggacagcgttttatttccaaatattgttcttcctagatctagaagccaaactttctatattttaagctacatgtcacactcctcttctacaactaacattaattttgctgaggaaaaaatacaaatgcatggtactgtcataataaagccgctgccaggggaagagaacacagctgatctcctcctgccccctcacccttctgctcagcgcagctcagagcaatgcacacgtgtcagaggccacagagaaacctgcggccttcttttgtcaacatttcttttagaacattggcaaagatctcaaatgtcagtgtgtagaggtatgacagataaagatttgtaagtgcgtgtgtgacagagaaagaatatgtatgctcaatgaagaagctgttgtacacatggctttggagtctgtgtgaggacaccctcaaccctccaggtcagcctctggtcctcccatatgaatgctatcccttgattcccaccagggtcatccaacactggcctcaagccaactcctcctaggagccttttcgactctcatgctcatcaaacagctgctctctgaacacattctaaagctcccctgcagactggccacccacatctctctcttcacctccacatgaggaatagcagtttaatcatgcataagttaatatttctctgaatctgtgcttaactcccttagactccaggatgctgtggagtgtctgtcagtgcaaagggcatcatcaccatcactctttcctggctggaggtggagtaggggtggggtaaaatatgtagggctcctgtagccagggagaagcctgatgagttgtcattcctcctgataggggcacatagatcaaatctatgatggtaatagaagggaataagacacctaagctcataaagagaaagcagtcccaccaatcttgtaattaaagaatagcaaactaatacaacagtacgtgcatctctcacacttactacctgggtggcttgaaggaacctgggaaccctctagagcctcgtttgtcaacatgggaaataaagaacataaaaccaagcatatagacctgtccagagaattgttaatgtaaaacctggcatatcatggaggaaatggtggttgtaatgtccctggtcgtgggtacatcaatcatctgctgctattcttttttttttgagacagggtctcactctgtcacccaggctggagtgcagcagcaggatcacggctcactgcaacctctacttcctaggctcaagctatcctccttcctcagcctcctgagtatctaggactacaggtgcatgccagcacacctggctatttttttttttttttttgagatggagtttcgctctgtcacccaggctggagtgcagtggtgtgatctcggatcactacagcctctgcctcctgggttcaagcaattctcctgctcagcctcccgagtagctgggactacaggcacgtgctgccacgccctactaatttttgtatttttagtagagatggggtttcaccctgttggccaggatggtcttgatctcctgaactcatgatccacccacctcagcctccccaagtgctgggattacaggtgtgagccaccgcacctggcctgtattttttgtaagatagggtttggccatgttgcccaggctgatttcaaactccagggctctagtgatctgcccacctctgcctcccaaagtgtgaggattacaggtgtaagccaccacacctgctttgcaattttttaaaaattaataaaactgaaagttggccaaatttagggcaaacaagtaaaataataattatgtacactattatagaatgtgtaatcttttaagggcattgggtcatacatgctcagaattccccaaatatgatccatatcacttgtttcattgattatattctggtgaatttgtgataagaaaacaattttaaaatgccccatgtgtcatgattataaaactataataattaagacagtacctggttatatgactaagatcaatgtgtaagaatgggaagtctagtcacaaggcccacatatttgcagttacctgaaaaagtggcagtgccacgcagaagagatggttgttttggttgatgctaagccaggtgctaggccaactggatatccatgagaaaaaatgattctgaccccaacttcacactaaacacaaaaatcaatgacagatggagtgcagatctaaaatgcaaatggcagaacaataaatcttttagaagaaaatataagaaaacatattcgtgaccatggagtaggcacagatttcttaaacaagatccataagatgttaattataaaggaaaaaatgataaattagaaccacattaaaatcaagaacttctatatatcaagacatcattcggattgagaagaaaactcactgaatgagacaaatttttgaaaaatatgtatctgaaaaaaaaaaaaaacttgtatccagaatatataaagaactacaaatcatcaagaaaaagggaagactgcccactgggcaaatggcaaaagactggagcaggcacttcatgaaaaagggcactccaaagaaaaaatagacatatgaaaatatgcccaacaaggctggggagaaataggaacacttttacactgttggtgggagtgtaaattagttcagcccttgtggaagagagtgtggcgattcctgaaggatctagaaccagaaataccatttgacccagcaatcccattactgggtatacacccaaaggatcataaatcattctacgataaagacacaagcccatgtatatttattggagcactattaacgatagtaaagacttggagccaacccatatgcccatcaatgatagactggataaagaaaacgtggcacatatacaccttggaatactatgtaaccataaaaaagaatgaactcatgtcctttgctgggacatggatgaagctgtaagccatcatcctcagcaaactaacacaggagcagaaaaccaaacacagcatgttctcacttaaaagtgagatttgaacaatgagaacaaatggacacagggaggagaacatcacacaccggggcctgtcggcaggtgggaggcaaggggagggagagcattaggacaaatacctaatgcatgcagggcttaaaacctagctgttggattgataggtgcagcaaaccaccacggcacatgtatacctatgtaacaaacctgcacgttctgcacatgtatcccagaacttaaagtgaagaaagaaatacgcccacgaggcaacagacaaatgtgattaagaccacaggaaggtatcaccacacagtcattaggatggctaaagtgccaacgatgaaaagtatggacgtggaaccaatgaaaccttcttacactgctgaacacaccatatggctgtggcccagggtttagagccaacagaatcaaacaagtatgttcacaaaagacatgcgtaaaaatgttcatagtggcactgtttgtatagacccaaactggaaactacttaaaagcccatccgcagcagaatggataaaaaaattgcagtgtatattcacacatcgaatgctatgcagctgtgataacgaatgagctacaactacatgcaacacagatgaatgccacacacaacagtgaggaaaggaaaccagacatagcaggcagaggtcatctgctttagaagtcagtagttactgtcaagcaggggaaaggagatgtcaggggatcctctggtgctggtaatgctgtgtttcttctggttgcaaggtgtgttcagtttgtgaaaactccttgagccatatccttatgatttgtagcatttgtgaatccttatggtttgtatgcatttctgggtgtattctatgcctcaataaaaagtttaccctccaaagtacaatacatatgaagacacacacacacagacacacgtaaagctcactaacaccagattggagaagcagtttcaatgtctcagtcctaccctataactcctgtagaccttctagctgctaacgcacagaatacttcattttcgacacattctgccccagtttatcttgcatctgaatttccttattgtattatcaaataagagatatatatatcaaaccttattagtgtttgtttcccataaaatccactgctccatttccaggtctgggcttaagacgctgatcggtgggattgccagctgagcagatctcagacactccagctcctcttttggttgaatcagtgggtcactaatagttattgacaccaactgagctcaatatcactggtcatcattaccagtccacggaatccacagagacagtcatccacatttcccgttgtgattggtgaggcattagaaaggatagattttcacagggcgaggttgtgaaaatgacttgaaaaatctcagtggctaacaggtaaaggcatgtcttcctcgcaccacaggttctgctcatcttcacgatccaagaactcaggtgacccaggtctccctgtttccatcatcaagatgggaaaggagcaggtgctggttcttaaagcttctatccagaacactcatatctcattgacaaagacaagcccgagattctcctcaaggatgtgccatcctccatgaaaggggcgctgaatactgtggattctggtgcctcccaccgtgggggcagctagggggtatcagcaacaccggatgctgacaaaatcacattgattttcttcccaggtgtggtttggagagaggagcactttgggtaatgagggaaaggaggcacagccagccagccagttagcaggatcaaccctggtcctcagtgggtgatattccatccagtcaattatatatatatatataatatatactcttattaagtatatattatatattaagtgtatatatatatatatatactcttattaaggaacaaaagttgggccaggcatggctcatgcctgtaatcccaacactttgagaagttaaggcaggaggccttaggagttgaacttgagcccaggagttcgagaccagtctgggcaacaaagagagaccctatctcaaaaaaaaaaataaaaatgataaaaccagctggccatgatggcacacaattgtagtcctagctactcagaggctgaggtgggtgcatcgcttggacctgagagttcgaggctgcagtgagccatgattacacttacacttactgcactccagcctgggtgacaaagcaaaaccctgtctcaaaaacatatttaaaaagaagaaaagttatttaatgatatttgctatcactgctaaaacctggtaagaaagactttcttcaggatcatctcgacaggcatagggactactgcaatgggattttgcagtgtgggagagagattgggctgaactctgaatacaacctggacaagtgggaatttctagcccaggagcatggtgggggtcagttgatggaaaattacaaggaataaacatcaaggataaggggaattctggctaagctgacctaacgggtttcttactgaagacaggccagggtgatcagactatatctgtggaatggtggaggtggaagatcttgatcaaatatagacgagataatgagggtggggagttcttgctaaactgacttggccgggatcttgctaaactgaactttacaaggaagtgcacagatgggcccaggagaaggttcaggagcctgactaaagtttaatcaaaaaagaatctttgtcattctgcaagctcagagggactcttgggtgatcaataataatttagctccattttcttttgtttgtccaatgttgtactttaaagaacacctaaagaaaaaataaaatacaatcaaaatttggagaaataatttctccatgaagatgtgaagggctctgtatttatttaacttaaagacaaggaacagagtcaacagccattaagtaagtgacttgataatacataaacacatttcctcattcctcttagagatgagacaaaaagaaattatttatttaacagcagagccatcttaggctaaacactaggaagagctgactttgcattttattgtctgaggagattgtgaggtcttaacatgcccctgaatgtagtatcactgaattaatttggggattccctccccccatcaaatttggaaacatttattgaggctttgctcattatttagtaaagttaacctcctctttataagagaagtgtactgaacatatgcataatatttgcagttctataaagtttaaaataaaaaagaagtttatatcacaggtggcaggggctcaatataagttgttaattttattgagtgaattattttaccataaaagtatgtttcagcattttctagaaacccttattttgtctgagaatctgatagagctgctctcaatacttacatggctcagctggcaaagggaggacaaaatgattgtaaatagctttgcttttcctcactgaaagcctttttaggttttgaagcctctaatgaagggagaagacactggctccacactccaggtacagagctgtttttgataagatgaaaaggatgtttttcttaccaggtatcattctcttcagaagtaatgtttcctacacaaagtgactgcatgtcaaatgtgcaatttgtctctccagagcacagtgactggcttcttcgttcctgatataatggctagctctggatttttcttggtaatttctatatctctgttttcctctcaattgtaatattcctgcatcagaagacgaactcagaagttgtggttctgcgaaaaaaattagtttctactgtgaattttcttttcttatcaaattgtactaaaataactgttcacaacagtgtttcaccaaatcgttctcaaatttggtgaaatttcatttaattcttcccattgatttaaaacataaggtatattggatgcctaattattgctgcaattatgttctgaaatacataacataatattgaccaactatattttctatggtggtaaaacatagataatgcacactgaccattttaatcctttcaaggtgtactatcaagctgtggttttctttgacagatgacaccatcctacagcgggagaccttctccccggttcacaccaggactccagaaaggacaccccagcgtatcctactgtggagcacataactggatgctaaagaagaggtctgcattaactgactgcccagcagctccttccccagctgagctcattgccatctaatccattgcaaatatacaggagcgtgccttggctgtctctttcggagtggagaagcttgacatttggatacgattggttgcagaagttaagaactaagtttcacttctttatttaacctgaaagttctcttaattccctgcatcattgtgccaataattctgctttctgagactttgctggatgaagaagacatctggatttgattttagagaaagaaaaagccaagacaatgaaataagtgtgtttgtaaatgtaacttttaggtccgttacatggttttgtcctgtttcttcccacccccactcccaattccccttcctgttaaaacctcaagtcaaatcacaaacctatctggctgctttcaaatgtaaaagaagactttacaccaaaaatacagacttctctaatggtctaaactacaacttcaaaacttaaattgttcctatggatgcaaatgcttaagaaattggtcgtaaaataatctctctttaaaatataaaccttagcattttataatgacaacaaaccatgtttctcattggcaaaagcactgctgtttctaagtctctcgtctcacaagaatgagagcctcactggtctccccccagcacctagagcaggacctggcaaagagctggccctccttcaatatctgcataatgaataactctccatggaaaccagtgccactgtggtcagtgacaacgtgctgtaacttactccgaagacagcaggggcatgggtgacaccgggagctcaggccatttgcaccaggctctctctgggtctttgtttatgccccttccccttcctcctcctctgtcactggcctctccatatgaagtctctccttttctttccctcctcaccatggcctttgtgccttttcttctccttccctttaattcccactttcttcctttgagctttctcttcccttcctctcattttccattgttctcctcccctttccaccttctcctttatgtagtaaaaacatggatctgacgtgtattttaaattggcattttaatatcctatcagcttccattcttcatttttctcatggagcatacaaattgtataagtgtttacctggcaacaactatgttttgcttgtttgtggcaaaaaaaaaaaaattgccacgatgacaagtgcctcttgccaagtcgggtgtgcaggtgcagagtcacacccagccgccctcaaggtccacacgttgcccagtcatctggcggttttctctctaacccaagcatcctggtgcctgcgatgaggggaataggtaaccctattgctacactcccagcttatgaagaacacagaacacagagctcaagggaaaagagaattcttttggagacaaaagataattttgtacttctaatctggatccctaaggtcgtgccctacctcccctatgaccatccccatctttactgaagtataattgactaatacaaattgtatatagttacggtggacaatgtgatgttttgatatgtgagtacattgtggtatgatcactataatcaagctaatcagcatatccatcacctcacatagttgccttttgttttttgcctgtgtatggtgaaaaaatttaagatctactctgttagcacttttcaagcatacaatgcagagttgtgcccttagttaaaggactcgggggctttgtgaggtctgaatcctattgattatccagtgcctgctttttcccccttccagtttttctgttcagttaatgttggtgccacatacattaaattgagtatgtggacagcagagtgcagttcctgaataaagagaatatgaaaatctattacttattgcttaagttaacaggaataagtgttaggcttatttctgattctataggacaatcaatacctgtttttatcaagtacctgcctccttaattaagagcaatagctgacaaaagttaattagcaatgtcaacatgaccctatcacgttgccctgctctgacttcaaagaaaatttagataatgttaaaggattagaaaagaataacagaaagtccagcatgcctactttaaaacacctgagttttcaagttctccagatataagttatatataactttttattatataacatattatataatctgagggaaaaaaaatgccacgatgacaagtgcctcttgccaagtcgggtgtgcaggtgcagagtcacacccagccgccctcaaggtccacacgttgcccagtcatctggcggttttctctctaacccaagtatcctggtgcctgtgatgaagggaataagtaaccctattcactcccagcttatgaagaacacagaacacagagctcaagggaaaagagaattcttttggagacaaaagataattttgtacttctaatctggatccctaaggtcgttccctaccccccccatgaccatcccccatctttactgcagtataactgactaatacaaattgtatatacagtggacaatgtgatgtccctctttcttcctgctaatatcacatacatttgtactgtttcttttgaaaacttgtagaaaacttggaggggaaagcatttctagcctctcctgttggtcagtggattaatttgcctccagtaagtgtctctgtggcttactgtcattcagctgataccgaagctttcccttcctggatgctcaggacatgtgatttgaggataagtttacctgggcttttcaggcatctttgtttgcttcttttcattccaaagcttttgctaggaacagggaagctgacacatcagcaggcgaggacccttcaatagtgtggagagtgagggaaggttgaacagctagagaacacaaagggaagaaaataatatactttgccatttctataaccttaatacaattttaataaaatttttctttggaggctttaaattcatttctttaagaagctttgttgagcaaaaatattcttacaattgccattaagtgcaccattttgttcaagatgaacccattaaactttttctttatcataattaagcccaatatgccaaatgccaaagattagctatcagcttagtacaaaccaggaagctgaagaatagctgtatattcattaagccccaaagagtgtgtttttgttttgttttgatgctaaggaaaggcaggtggctcaaacccagggcagtgtctttgtctccacaggataagcctatttaactcagcttagttcatatcttcagatgcaatccttagcagaccagtgacctcggggaaccctaaagccagacagaccacctgcaggggagagaagcggatcagaggaaggtcacaggtggcatgagtggtgggctctgacaggaataagcccgttaatgggctgttatggaaggaaagctggtcatctggcctcccacccctggccaggagaacctggactgcagtttcaatctcactgcatgccatttagatgtttgtctgcagtgctatctgtggggttcttgaacttgtgacttttaaaagacaatacaaggatggactggtaatgactgacatttagttgaatgaaaattacccagaagtttaccaagcaataaacttcaatctaactagatacccaataaactgtatacaatatgcaaatgcagaattgactgactgagaacattaattattttcctgtggtccaattatgaaaggaaaagaagcttttttactttgctcttttcaaatgcaaagtggttattgggagaaaaaaggctggattcttacaagtgaagcagtataaagaaggggtaggtaaaggagagtggacgaacctactcagagaaggattcactgggcagaggaggggtagcaatgggggttctgctgggctggagacctggactcccaggtagcaccccacttgtgactcacctatgaaggtagcttgtggtgacttgaaggcttatctctaggagctatgacctttgaggctgcatcaaagacccaaattatcaaattagtcacaagagagtagatgccgtgaggagcaggttgttctaccatcaggtgggctatggaaaagtcagcaaacatggctgatggaccaaatccggtcagcctcctgtttttgtaaataaagtttcattggcacatagccaaacccatttgtatacttatgacctatggctgttttcatacttcagaagcagagttgagtagttgtgacagagaccgtatacatagtctgcaaagcccagattatttactagctggctctctactgaaaaaaatatgctgacctcggaacagttagtgtggactgtgggctgagagtagattgcacccgctattctccccttaccctgcagtcaggagatcctttgcaaattttctggagcccttaagtcctccaggatagtcaagtgatccgaggccaatgaacgatgactgatatcacatatctcttcatcttcccaattcttgccagcttagttccagactgaagtatgagatgatattttatatttatattatgagcactgtaacacaaatttatacctcctaggtgcgtcattggtttcctattgttgctgtaacaaattgccacaaactaagtgacttaaagcaacacaaactgattatcttacattttgcaggttagaagtccaaaatcattctgtgtgaactaaaaatcaaagggtcatctgggctcggctcctttggaggctctgaggcggattcagattcttaccttttagaagcctcctctagtcctcagcttgcggccccgtcctccatctccaaagagacagcatcttctctcctctctgacctctgcttctattgtcacatcctctttgactctgatccccatgcttctctcttatcagggcccttgtgattgcattcaacccacctggataatctctctgtcttagatctttaatgtaatcatacctgcaaagccccttttgtcatgtaaagtcacattcccaggtgctagggattagaacgtggaagtctttgaggggcgtcattcagccagtcacacatagagaactttgaggctttgataccaacttcaactctataaagaactgctgagaagccatggctatctagggggaatgggactattctggtcctgtctagagtctctactttctattcattctcaactctcattcaggaaagggatgggtggggaacagcacagacagtcactggttcatagctcttatcagcactgcctgccaagcgagattggccagggacccagccttggcaacggagtgggcacttggacaaccttatttagtaaccttggaggacccctcttgtcctctaccgccctgactcatatttccactccctgggaggggcttccttgtctacatcatgttcctccatggccataccttaggtggacattggggagaatgcctttctaggggaagcaggtgtaggttttgcagtgcagtacttgttgcaggtttagggatcaggacactgctgtgaggggtcaaatactcaaaggctatttgtgaccagactccaactagtgttacagttttcctaaaaaaaaaaaaaaaaaaaaaaaaaaaaaaaaaaaaaaaacgcttctaatttgttatggactgaaatgtgttcctaactcctagtatctcaaaatgtgactctatttggaggtaagctctttaaagggtagttatgtcaaaatgaggttggatgagtgggctgtcatccaatatgctggcgttcttataagaagaggagattgggggggcacggtggctcacgcctgtaatcccagcactttgggaggctgaggcaggcggatcacctgaggtcaggagttcaagaccagcctggccaacatggtgaaaccccgtctctacaaaaatacaaaaatcagctgggcatgaaggcaggtgcctgtaatcccagctactcgggtggctgaggtgggagaatcgcttgaacctgggaggctaaatttgtagtgagccaaaattgcgccattgcactccagcctgggcaacagagtgagaatccatttcagaaaaaaaaaaaaaagaagaagaagaaggagattgagacactaacgcatgcagagagatgaccatgtgaggagaacatcagaagaagatggccacctacaaacaaggagggaggcctcagaagaaaccaaccctgctggcaccttgctctcagatttccagcctccagaaccatgaaaaaataaatttctgttgcttaagctgctgaatgtgtggtgccttatagtggcagcctgagcagactaacagagattctaagcaatgggagctccgtaaggtgtgtgtgttgggggagacatcagagaattgttagcagccgacactcacagcagctgggggcactggcccaggaaagggcttctgggcagccaccaaaacagcatctaccccagcgggcaagtccccagtcacaaaaagacagtgcagattctggagaatcaaacagaataagagctttcgactgctctatgctatgaaacacaaaaattgggacaccaccagaaacttttgaagttggagcttgaagtctctttgcaggcagaatatgttttgccttaaaaatagcacccaatgataacccttatcaacatccattctgcagataacaggcctccctcagggaccatataggtgccattctcccctaaagtcaactgcagcctcaaagagccattgaattcataaggcagcatggagatataggtcatgttttcttccctccaaacctagaagcttgtaagggtacatgctctctagacacaaaataccatatttcctttgcatcttaatccactcaaccctggttgcagtcaccttcttattattcactccatacaagatagatgaattttcacgattttccagtttccgttctggttctcctgttcctggtaggacaacagagaatactatctttctctttcttcaaagattctgtcctgtgagaatgttcctctccagtgatctagtataaactgcaccatccagctctactcatgatttcgctgaccatagattctttgtgacatagtttcttatttctcatttctcctgtgatgttataccctttgtcaagcacagaagaaataatggaaactacattcacctttattttctatgcttgatagaactagtggtgtatagcagttggcatcaaaagatgaaggtacaataagacatttgattagtaatcaaagaggtgaatgaaataagatggaatgccaagttacacagtggtataacccaatggtgagtcggatatgtttttttaaaagcctacacattttcttctgcataggacatcagacaatgaaatacaaacatgtagagtttttttgttacaatcaaagctagaaaagtttagggtattttcttagtaaagagtcttcgtatggttaggaagaggtcttcaggcaaatgtaccatttctctataggagaaatagctctttcttctaacaactgctgaatttagttttcagatattaaatgtgtataaaccgaatggacatccatcaaaaggattgaattggtgcaaaaatgagtgacttttgggcctctctttatggttgctttgagaactgctgcatctaaaagtggactacaatggaaggtgtagatccagcagaggaacacactggggaataagaggggcaattttaagcatgtaggtgatctcaagtaggctgatctcaagtaggcagaccacaaaggatctgaagccaccaacaatgttgagcaaagatgtccagagacacttacgcgggtcctgcattgatggtcatccttgcaggtctatgggtggggtagggctatgggaggctcccagttcaataaaatgaggcaagtatagagaagagggtctctgttattcacaggaccattattgaaatcagttccagatatgtttgagtaataatagttcaacaagagatggattccatgggaaagaaacttgcaaaagactaagaagggaagcaagtctatcaatacgcaatcaggactgtatcccacaaacgaatgctgtagttcctctcttcagtcaggacttactgaggatttgctacatgcattcacgaggtcagcacttggcatcagttgagcagtatcccttcagcagtatccctgaagctaacgtttcagtgggagagcaggtggtgacccttctgtaaagcaggtgaggggctgaagaatggagaggaagggggtggagttttctacagcgtgttcatggaaggcttccctgagtgatacagtgaaaggaaatgagtcacgcagagatcttggggtgagatgggaggaagagggaatattccaggcaaagagacagtgacagttaattttaggtgtccacttaactgaattaaggaatgcctaaaaactggggaagattgctttcgggtgcatatgtagggatatttccagaggagactggcatgtgagttggtggactgagtggggaagggccaccctcaatgcatgtgggcaccatccaatcagctggaggcccgatagaagaaaaaggcagaggaaaggtgaattcaccgtctctcctggagctggggcacccttcttctcctgcccttgcacatcagaattataggctctctggccctccttggattctcaggcctttggcttcagacccagagatacactactgacttccgtggtcctcaggcctttggacctggactgagcttggtttctctagttcttcagcttgcatatggcttattttgagacttctcaaattccataatctcatgaggcacttcctttaataaatcccatctgtctgtctatctatctagctaaatcttcacctatgtttattgtattgattctttctggaggactctaatacaaagactaagtgcaaagatcctgatgtcacaatcagagttgcaagttccagcaacaagaacattggtgaatctgggacgggtattgaaggagatgatatcaaagagacagacagtggctggacatgtgcagctctgtatgggactcccacccttcatgggatggaattccacccttcattgtaggttttgtttagggaagtaatgccatttgatttctctattaagaaggtggctaggtggccacagctgctcataaaatccattctgagatcatcaagtgtaaaacccagtgcatttcatgaagcgttttacttgatgctcacggcaaccccataggagctcacttattatatttttgcctggagtcacacagacagtgaccgaatttggagtcaaaccaagacttgtagaatagccacagtactgcattgcatcacaagggagtgtgggtgaacgggcgagagtaactcagcacagagaaaattagaaagaagtgaggtccaagggttggcctcagctgccatcaccagagagcactgcagtggggattgggacctgaaatccaggaatgggctctagttccattagctcatactagtttgttggctgaggcaagccatttaaatcaatctggacctgctgcttcacaaataaggttgctgaactccaagaccccaagttacattttgctctcggtgatccatatactgtataaatgaagtattacactatcaaaatattttatattgaattttattatggtttattaggttttatagaattaaaaattataggagtagaatggtctcaatcagctcattttatttatttcttagccttatggatgaaaaataatgaaaaccacaaataaataaaaataatatctttgcagccaggcgcagtggctcatgtctgtaatcccagccctttgggaggctgaagtgggtggatcatctgaggtcaggggttcgagaccaccctgtccaacatggtgaaaccccatctctactaaaaatacaaaaattagctgagaatggtggcacacatctgtagtcccagctactcgggaggctgaggcaggagaatctcttgaacccaggagacagaggttgcagtgagctgagatcgtgccattgcactccagcctgggtgacagagtgagactccatctcaaaaaaaaaaaaatcattgcaaatatgtattaatatacattgcatacacagacatgtttcatataaagacatacttgtacacacatacacatactcccccagccaccagtacttctgtgtcataaactctaccccagtgtgactggtgctttctggagctccaccaaagagttcctgccccagcaatccctgattttaccctccggagacaatcactgtctaaataggttggctctatctcttgtggacacggaccaagtttactaacttctcagcatcttcaaacactcttgggtatgtctggggaatttctagccttgtgagtcccaccttcccaaagcagaccccaaaggactcagagttgcaactttgacagctgggtcgcaggagttttcaggctccaccaagctgatcctcacaccctagaccctcccttgagaaggatcagcctgaggaaggaggctccaccgggatctacctttggtggaggcatctgactcctggaggtgacagcctgctgttctagccactggagcaggtgcaccatgggacgtagggtagcagcagctgtgtccaagcttgacatcagggcaaactgtagcatcccaggcttagtgacagggggtagggggactctcactgtcaggccaattcctggaagcagagagcctatttctctaggcctcttaaggatgtcgtggacaccccagtctactctttttcactgaatccaccataatgaactatttttcacttgtaactaataaaacggtgtgatcctgactgcccaatacttgttgaaacatgtctccagagcctatacacatttaagcaacatgtatttttatacttaacaatggaactcagctgtacacactggaaagcttagacccattctttctttttgactgccccatggtatttgatggtattgtattggtgaagcatactttgcttaacaagccccctattgctttacatttaagagatttttcttatttttactgttctatacaatgtagcctgacacacatttgtcgttttcaattcactctgtggctttcgtacagattactaaacagtaagattgctgaaagattatatatgcacagtaaaatttttaacatataaaaacaaattttattttcaaaggttattccaatttatacctgcattaaatatttatgaagacaccaatttttccccacccttgctaatacttgatgttattagtcctttgaaatgttgccattttgaaaggcaaaactccacctcattttaatttatatttttaaatttattagtgatttttagcatatttttacatatttactggccatttgtatttttcttctgttttacctatttatatttgcccattttctatttttttactgacagagatcacattatatgttgtacataataatatagcacatattgcatgtaatttgtgtatattctgttgcaaatactttccctaagtctctcatttatcctttaattttattagggtattttctactacacaaagttctatttagcacttgctggagtgattcaactttagaggatttaacaatataattaagtaaattaataaataatttgagtaaaaaaaaatcacatcaaatacaaaggaaaaaagaattattgaattgagacaaaattgttcattaaaaactttaagtaaagtaaaacgtttgattaaatactttaggtaaaactttaaaaaaacttcttaagatgagtttcgaatgctatcagaagtcattatgaaaacattactctaaactggaaaatcctcaatgcattctgactgaagttggaagcaggacgaagtgtagggtatctcctcactataactcaattgtgttcaggaggttttagctaatgcaatcagatagaattaagtgactgatataaactgaaagagagataaaagcagtatcactctttgcagataataagattttactcctagaaaatgcagggggtaaaactaaaagaaaaccttttagaactaattttcctttcaaaaatttcacaggaaggtgtcactgtgtaagtagtgactttgaaaccctcaacagctttcctctatgctagtagtaactatttagaaattaaaatggtaaaagtttctattcatgacagctactaaaagtacaaatggccaaaaataaatttatcaaggaaaatacaagagtagaatgtatatttcaatattaatattttactgaagacataaaataagattccagtaaatggagacatgtcatattcctgtatgggaagactcaacatcacaaaagcttctcaaatcaatgtataaatttaatgcaattccaatcagaattctaatggattgtttatatattctggtcctgcttttgaaactgaataagttgattataaatttcatagggatgaattaccttgataatttctgagaatgttttgggaaattatttttcagatatttaagtgtatgttagagctactctagtcaaaactatatattactagtataggaacagacaagttgatgaccaaaacagaacatagagtccattaaccaatcccaaaatacgtgttttattatggtaaatgatacttgaacaaatagctaatagtttacaagaaaaaatatgcatttatgctaaattaaaaaataatttttggctagattaaagatctagtgaaaagataaaatccatttaatgttatagtaaaatataggagttatgtttttgttgttcagccaagtggggaaggtaattctcactaaatctgataacctggaagacatgcaaaaaaacaaaagaaaaaaaactcaccagatctctttgattatatattaaccccaccatatgataggttaggatataagacctataagtgggaataagtaactcatgcaagatcactggacttggcagagagacagaataaagggctaatcagatggtcagagtgtttaagtggtatgagctacacacttttctctttcccagtcgttcataaactttaatgaacattaaaaaccacctggagtgctcattaaaatttacctgactcccactcccagtttctaatttaatagatcagattagggactgaaaatttgcatttttaataagttcataggtaatgtccatgctgcagagtgtagcatcacttggagtaataatttgctatgcaacttccttcaacaaaaaatcatgctgcatacacacccacacacacacacacacacacacacacacacataagcttggatgtcatcaaagagcatacattttatgccgagttattttaggggtacatccatgttatgggctagggaaaacttagtctgaggggtgaacaggtagaagggtcaatgtcaaattccatcagggagagaagtatcaggtcaggttgagattacataaaaacaacataattaagacatttcatttatcaaaagaaagttataggatattagtgaaaatggcagtgcaatgacgttcaaaaatctcttctccataaaagtgatgagaaaactggtaaaagttgttggaaacaaatttttctgaactctggaaattaaccaaggcttggaataacctggagagggttcattcaagaaaaaatggctgaatttcaggaaggccagtgagcttagggcattttaatagtctcattccctgctctccaggtgcacagtaatcttgtaaaataaaactctgcattcctattgcagcctggcagaacccccagaggtaacagaatgaagctggagatcttacaaagctccacttccaaataattgccctttaaaaagaaacctatttcatggtttcctggaccgttcccacttacaaggctgtctgtatctgacctgacttagagactgcccaatacaaaaagccttctccccaaggaacatttgttgagaacaattaataggcacatattttaactttgtaactgcttgaggtggtgaatagcagttgaaacaaccaataggctagccaaaaaagctgtaaaagaaaagctggggcatgagatagtcctaggacttagaaaatcctgacctattcctgggaatctagaaggtcatgtgtatgtcaatattggccacatgctccaggctgtgtgcatgctgaggaaagacctgagaaggtcctatgctctcacctctcgctgaccttgaggctctgtgaaagcagaaagggaaagctaggcaatattgtcaactgcctgactgagtgttgaagaagtgttctaacacatgaatatagctccttggcagaaacagaaagatttattggttccagacatttgaggaaacctctatctaatcattagctacagagacttcagtagccacacatggaaaataatacagattttgcagaattagtttagaaaaatccctaaataaacaaaaataactaacaactacaagcagcaatagctataaacctggagtggggaggatctaattttcatgattgtcaaattatattattttaaatgtctagtttccaacaaaaattgtgagacatgcaaagatacaagaaagcatggtttatatgcagttggaaagacaagcaatcagtagaaattgtctctgaagaaccccaaacgttggacttactaaagaaatactttaaataagctgttttgttcaaagagctaaaagaaacaatgtgtctttgcttgaacatttttgaatatgttcaaagagccaaaagagacaatgtctaaagaactaaggaaaagtatgatgtgtcagcaaatagagaatattaataaagaaataggacttttatttggaaaaatcaaatagaaattctgcagttaaaaagtacaattaatgatatgaaaaattcactagagggctcaacagcagagatgagcaggcagaagatagaataaatgaacttgaatatagtgaatagagattatgaagtatgaagaacggaaagaaaacagaacaaagaaaaatgaacagagcctcagagatctgtggaacaccgttaagattaccaacaacatatgaataatgggaaactcagaagaactggagagaaataaaggggcagaaagaatatttgaagaaataatggctgaaaacctttccaattcgatagaaaacatttagctacacagccaagtagctcagtgaattgcaagcaagataaactcaaagagatccacaagtattcataatcaacctgccagaacccaaatacaaagagataatcttgagagcatcaagagagaagcaactgatcatgtacaaggaattcttatttagattacaaagagataatcttgagagcatcaagagagaagcgattgatcatgtacaaggaattcttatttagattacagctgatttctaatcagaaaccacagagaacagaaggtaataggatgacatattcaaggtgctgagagaaaagaaaatgtctaccaagaattctatatttcgcaaagctatgcttcaaagataaaggagaaattaatatttttccatctttaggaaagctttgtatagccaccatggctctgatctcatcttgaattgtactgtcataattcccacatgttgtgggaggggcccagtgggagataattgaatcacgggggtggtttccctcatactgttttcatggtagtgaataagtctcacgagatctgatggttttatcaggaatttccacttttgtgtctttctcattctctctttgcctgctgccagccatgtaagatgggacttgctcctccttcccttccaccatgattgtgaggattccctacccatgtgggactgtaagtacaattaaacctctttcttttgtaagttgcccagtcatgggtatgtctgtatcagcagcatgaaaacagactaatacagactcactcctgtaatctcatcactttaggaggccaaggtgggaggatcacttgaggtcaggagtttgagaccagcctgggcaacatagtgagacctaaattctataaaaaatttagaaatagctgggccatggtgttatgttcctgtagtcccagctacttgggaggctgaagcaggaggatcacttgagcccaggaggtcgaggctgcaatgagccataatcaggccactacactccagcctgggcaacagagtgagaccctgtctctaaaaaataaatacatacatacagaaataaaaattaaaaaccaagataattagtcactggtagacttaccttactagaaatactaaaggaagtccttcaggcagaaatgaagaaacactaggcagtaacttggattcacgtgaagaaataaaagagcgacagttaaggtaataacacaggtaaatacaaatgacacaatcattgtaagttttatttgtaactcttttctctgatctaatttaaatgacaactgaataaacaattataaatctgttgatgtataaacaatggataaggatgtcacttgtgataataacagcacaaaaaaggggcagacaatgaagagcaaagtcttgtgcactgttgaaatgaaattggtatgaatctgaactagtttgttataaattaagatgtgacttgtaatccccagaacaatttatatgaaaatcactataaatatatggtaaaatacatgaaaagaaaattaaatgatacactagagtatatttaacaaaagaaggcaggagtaaaggaacaaaaaagacatgaacatgtagaaaaaaatagtgaaatgtcagacttaaagacaaggtgaacattcttgtctgtggtacaaggactgagatggattgatgcaaacaacagcttgccaataccaggagatcaataggagtgaggaaggagcaggagagaaatactcctagaagcaaatccatggtggtaaatcctgtaccctcgaccccaccaggtagtcccatttgtccgccctgcaggctcttgagctgttcctacctgctccagggttggctcccactcagtagtgggtttaccataacaagaatgaagcttacagtaggagacttccttcagagattcagggatgtggcagattcagtcactggccaggtacatggagctctgccccagcccagtagtcaccattacattttgctggtgagaggctacaggaaaggccagagcactggcagcattgccttgcatcttgcagccccagtggcagcctgccccttttggaccgatggggcatcccgagcctgtgactgacttcatggagatggatctgaaggatgctgctcttctccctgcttggggtggaccactcctgcaagagtgagaaggttagggcgagggtgtgggaaactggagggtcacatcctgagagattggaaaattaaaggcccaagctgtctgagggcttggcctaattctccatctcccccaaccccctagagcctctgctcccactagaggctctgagggcttcctttgactctgcacccctctctagtccccaaagaagaacccgctgagcaagaaactgcacagaaagtcaccattgtggattaccagttatgagaggcaaaactgaaagaagcttttctaaactatcaataataacaaaaattctgtcaacactgctagaggaaagatggaattagctttctattctctctgcagaaaatgacattacaaaaccgttgtcataggaagaggcaataaaagaatatgcaggaaaaaaaaaaaacacagagaaatgagtattaccgatttgtgtcaggcagtcaatgacaactgctaacaatttcatgttatttttctggatttaaggtatctatgatatttggtagctttttagtatttaaatttgcacgatttttttcttgttcattatctaattctgtattctttttttttgtctaaagtggcttacaaattgcataagctttagaccgcaaacacctccagctgggcctctacccactgctgatagacgacccccaaagaggccacaggggaaagcaggcctctcgtctcagcagaatctctcagtttcttgttatgtggttggtcagtgtaatcacttttaatttaaaaaacattgtacctcatctgttttgtctcctttgtagtcacacatataatttgtttttgtcttccttttcttcatttaaaagccttatcagaagagtattatttttatttatttatttatttttttgagacggagtcccgctctgtcgcccaggctgcagtgcagtggtgtgatccggctcactgcaggctccgcctcccgggttcacgccgttctcctgcctcagcctcccaagtagctgggactacaggcgcccgccaccaagcccggctaattttttgtatttttagtttattttatgagattttctttaaaaaatgttttgcttttgtagattttgtttctttgttatctaattcaatttctactattatcctcttttactctttctgccaaaaaatacagaccagattttaaacatcaaaacaaaaagctatggctacagtaaggatgaaggccaagtcttcactcccatggcaattttctcctagctaaggcgaggtataaaacaaattaataactgaatgtataatttattgtcaggtagtgattggtactgtgaagaaaaatacatgtaggtaagtggatatggaatgatggaggtggcatctgctttagatgggatggtcagggaaggactttcaagaaagtgatatctgagcagagacctgagtaggtaaggaagagagcaacactgtgtgtgttctgggcaaagggagagcaagtgcaaaggccctgaggtagaaatgggattggagtgtcctagtacttgcaagaagggcactgtgtgccatgcagatcaagtaaggaaagcagagagagaggttccagagctcagatcttatttaaccctattaactatagggagagtaccatttttattctaaataagaaagcaagacaacagagagtgtggggctggagagcgctgaggcagattgacgtataaatctacaacaactgctggtaggaaaacctcccttccatttgattccacttctcagaacttgcttgttggccccagaagcacaaaggagctgggtcccaccaggaacagctgggcagcagtgaatgctggaaaatgagagaggaagagacagatggatgaggattagaggaatcctccaacgggtccagctttgaatgaggcagaaagtgtgaaggtgaatggagagtcactgacacagggacaagttctaagacttggaaaaggaggcagaaaacacagcagaagttagaaggagtctctcttttgcctttattattcatttgttccacaagtaacacacgtcatttgtaaacatattagaaaatacagataaagaagaaaaagagtcattttaaattgcaaatctaaagattgttaggttaaattgcaaatctaaagactgttaatattttggtctgtacagttccatctttcttacacatttacacatatataaacatgtatatatatatatatacatgtatatataatgtatgctttttacacaaatcatatttgcattatactgtcatttttgcattaaatattttataaacatcctcatgtcaataaatgtaggttactattaacattttcaattagtgcaggaagactgctctgtatgtttttactatagtttatttaaacacttccctggtcatttaggtttttttcacattttgccttcataaatggccacgtaacagagctctctaaatttagatgctgggcacttgctgtttcttgatactaaatacttagataggctatcgctaggttaaagaattaaagatttcaaacctctagatatatcagcaaatagttctcaaaaagtcttgacttaaaaattcccccaacatgatgttcctactacccccacaccatcaccagtactggctacttcattattttgcatttttgttatctatccggtcaactgtgacactacttaattgttgtattagtttttatttttcttactaattttcatgtacttattcatcttgctggaactgcctagttcatatcttttgcctactgtgttgagcaggcttgtctttttctcattgcttttgagagttcatattatgtttatagtaattctattacatatgttatggtggtttcccaatgttattttatttttttttaattttttttatacagagtctcactctgttgcccaggctggagtgcaatggcatgatcttggctcactgcaacctccgcctcccaggttcaagtgattctcctacctcagcctcctgagtagctgggactacaggcgcccgccaccacgcccggctaacttttgtatttttagtagagatgagtttcaccatgttggccaagctggtcttgaactcctgatctcgtgatcttcccacctcaacctcccaaagtgctgagattacaggcgtgagccaccatgcccggccccagtgttctattaccatggtgagattttatttccctgtagagatagttttaaatttttatgtaatcagacctatgaagtttctgattgtaatgtccaggttggaaagacttcccctgccccaaagttctatcaatactcattttatatttctggtaaagatttatatttacattttaactcagctggctaccctagtcctactagcattacagtgagaaacaatttaaaaacaaagtcacccagttccactagcatccctccttacaccaacattccctgttccaccagcctccctccttacaccagcattccctgttccactagtactccttgcacacaagctctcctcctgactcctttttctcgtagcttatagagtggcctgagagtaattaatctctggctctgagcacagtgaggctcagcaggctccaatcacataaggcacagtccctaaggcttgcttctatctctcctcaggggagggctgtccccagctcctagagcggccccttgtgtcttctcacacacacagggaggaaggagatgaaggaatgacactcctcttagagagcctgcctatttggcttgacctttccctacatctgtctaaagtactgatggatggccgtactggagacactgttagactctcttcagaagactgtctggaccaccagtgacccttaacacagacaagcatatgctgtggaagagtagcttctagacttttcttcttcctctgcagccacccccatttagtacatgccaccagaaggcaatcagggtatcaaatcattctgtttgagctttgaaaacagtgctttttaaaactatgaatacaaggaagaggtacacttcttaatccccatagaccgttgatcttcccttgagatttctgttcaaatgtcactgtgaattttctactccctaaatttactaaaccaacagcatcccagcacacatgtacatactcggtattattgaaatgctgtcactttggggatagagcagctgtttcttacaggcagtaaacaatggttttgaacaggaagcaggagaaaacatgtccggagaaaactttctgggagaaaaacaaacattgactaagtttgattctggtcaagtgacacagttttatctagaaagtgatatcgcagaaactccatgttctaatatttaattatatgattaatacaatggtcacagattacttaattataaaattgttagtctgcatatttactggtccatttgtaaagtaaaataaatgagttcctctatcactgtcgttctcaaaggcaggggtagggtggggtggggggagcaattttgcctgccagggacatttgacgatgtctggaggcattttttaattgtgacaactgggagggtgctactggcatctagtggctagagaccagggatattgctcagcatcctacaatgctcaggacagcccctgccgctgctcccatcaaaacaaagaatgaccagccccaaatgtaaatcgtatcgagagaaaagtgatcaagaacaattaggaaaggcatctcctacatgttctctctgattttctcccagtttaatgcaagcagaaaaacgttgacctatgcccagaaggacactcgtgacgcaggaaaaatggaaccctaggaagcaggaatcattgccctgctgatgggaaggtcctgggaacatggagtattagaactatgtttatgggggcctagtccagtccctcatcccaggtcttgttccctccatgtcatgacttcagtgccctccacactgtaaaattcaccagtgaacggcacgtgaaaacttccaggctttctgtgggtcggagcatgggcgcatgtcccaagtgctgttgaaccctggtctcgggtcggctcagctcaagctgctgttaccacagctccatcttcagctccttaacatgctcttcctctctacctcctttcttcttttcttctcctggttaagtttaagaacctgcagtcccatccacccctgctccaggaaaacctcagcaacacttctctggtctactcaatccctcctttcctaggggctccttctcttcatctgtgatctcccaggaagcaaaggttcccttgaacccatctaccatcctcttcccaagcctccaactcaccttcttgcaaacatggtttcagctatctcctctgtcattgataataatgtgtgtcacacactgtgctaagaatttgaccctcaatacccttaggaggtcaacattgctattcagcccatggtacagatgagtttgaagacctaggttcaaaccgtggctgtggcagtcactcagcctctgagtctcagattccctatttgtaatgggaccaataacatcttccttgggactcagggttttaaaatataaagatcaagtgaattaaagcacattatcatcatcatcaccacgagtgctttaatgtattattgattcaatattaatttctaaagaaaccaaataaggagacaaggtataatcatttaacatattcctgactttctatctgtgtcaagactttgaagaaatcacacacagggtctgtttccctatgcccagcccagcaacgacaagccctcagggcagggactgtgcaatctgatcacctgagccagaatcctgatggctgagtgattgcaggcaaattataccttccagtaaccctgtcttcttatctggaacctgaggatgaaaataaggatgccctccatgctgtttggaaattcattcaattaatctttgcgatgagctgaggacagagcccaaaccatattacacacaaggtatgttgccaatcttaccacacctccagggaggacttgcagtaagtaacatcgctctctgaaacacccatgcttatggctatgagccatctctgtctgctgtaagccgcccccaagtctctggcctctgctctgcctcttggagtatttctgtctccttccatggccaccctggccagcatgcactggcatcccccatgtgccaagctgcatgccaagggcagatgtggaaggtccagtgacttgggtaatcttggcaggacacagtgggtgcagaatctttcacatgctcattttgtaggtctctaacttgctgaggtttattgagaaaacttaaaagctaattaggttctatgtcaggtcctaagaaaaaggcttaaaaaatgaagatgaaaagcaaaagttactggataattattttaagagagagatttgcaaattaaagtctctctctttgcatctattaaattagcaaatgttaaagaataagatattaaccagcagtgttggccaggatataaaacaccagcacattggtgcacagctagtggaaatgcaaatccatacaattccaataaaaataaatttgccactgtatttcatagccactgatccagtaatcctcattctcagaacctttcttagagaaattgtaaagagtaagaaaaaaatccacaaaggtgcccactacatattatacataatagtaaaaatgggaacaaactcaatgcccctaaataaggaagctgataagtaaatctattaattcatattttcaacaaatatttataaattgctccatttctgagttctctgctatatcagctcaataaaatatcttgtagtcagtaaaatcatcaataataaaatatgtaacataagaagtgaaatgaaattcataaaaatacacttttgccatgattataatgatgccaaaattaaatatttttatttgcagtgtttgggaacatggacaaatcaaaattgctcatttattaagatggtgaattctagattattttcttctccactacttgttattcattattacattatttgaaatgaagaaaaatcttattaaacatgtaaaaacgccaggcatggttgctcacgcctgtaatcccagcactttcggaggccaaggcgggtggatcatctgaagtcaggagtttgagaccagcctggaagacgtggtgaaaccccgtctctactaaaaatacaaaaattagctgggcatggtggcaggcacctgtaattccagctactcgggaggctgaggcaggagaatcgcttgaacccaggaggcagaggttgcggtgagctgagattgtgccgtcgcactccagcctgggcaacaagagtgaaactctgtctcaaaaaaaaaaaaaaaaaaaaaaaaaagtaaaagtccccactcttgcagtcctgtgtgagccctactctgggactcccactcccgatcgtgactctctgcacatgagtggcagcagcggcctggcctgggtcttgcttgaccatggccacgggagggctcagcctgtggacctgaagccactttcccaggaagcccctgcttgtttctccagattgttctgctgtactttatttttgctctctcaaatacgatttaaaaccccaaagagaacacactggagagtcatttcacaagaagtccatctattcatttcacaagaaatgactctccaaacacgttggagagtcatttcacaagaagtccattctattcctataaaagcagggagatagccattcatccttgggatccctctgggaattctttagaagcagtgaggctcaggcctataactgacaagctctgctccgcacattccagtggatctgggtgcaaaagctgaccaagcggctgcgatttgcaggggtggaaacctggaatgtaacaaaatacaaagcatgggaaaaatgtgtggcattttcagtttaagttggccagctgagctagctgaactaagccctggctaaactcatacgtgggcaagggcagctatcaccaaagataagccctctgagagtgccttagagggtttatagctatagatatggaaaccagtcccacccgaaaagacatttttatttttaacattctggaagcatgccatctgtaatcagtttgctcactctgaatgagctcgaatgattcaatcagtctttaaaattctttactacaggcaatcaagcacaactttgatgccccgaggggttagagtttctattccctgatcatttgctccaagcaccttctgttcaaaaaaaaaaaaaaaagaaaaagaaaaaaagaaagaaagaaaaaagaacaaaaaaaagaaagaaaaaagaaaagaaaagaaaagaaatatgctttttaggtttgagtttgacccttaagatgagtttcaaagtaaactctttttaaagacaatgtccatggacttgggttttttttgtttgtttgtttgtttgttttgctgtatttcaatcactgcacgtgcttgtgttcaatggcctgtaaaatgtcttgtgtactctgaaaggagaaggagttcatattggaatggcaattgtctatttggattctaaaagtatctgggtgcacagtatttatctgttagcctaaacacagtatttatctgttaacctaaacataatctgattgtaatggggaagactaattgaggtttaatcatgagttcattcacaatggagattcggtcacctgtgttttccccatgaacaggaccagaatatcctggtagaagtacacctggttctgctccttttcttttttggtagaattttttttttattgtggctatatatatatatatgttatatattgtgtatacatatacatataataacatttaccattttagtgtataagtcagtggccctcagttgtgtaactatcactactatttctggaaggttttcaccattccaaacagaaattctctatccattaagcgatcactccccatttcccctgccccctagccccttgtaacttctattctgctttttgtctctctctgattttgccctctatgtgggatggtacagtatttgtcctttgtgcgtggcttatttctttcagcatcatgtccttagggtttatccatgtcgtgacatgtatacaaacttcattcctgtttaaggagtattccattgtattaacatgcactttgtctccgcatttatctgttggtggacatttgttttatttccaccttttgactattgtgaataatgctgctatgaacacgggtgcacatctatctgttccagttcctgttttcagttctcttgggtgcatatctaggaatggaattgctgagtaatgtagtcattctatgtttaacttattggggaactgccaagctactttccatagtgactgcatcattttacattcccacatggtaggattattttattcccagatatttgctacccttctgtgaggaattccgtatctctcctttttactctgggcttggctgcctgatgtgcaactggatacgacaaaagctttagacttccccggtccccattgttttcactccttcctctagcctgttccaaacaggagctgctcctgcaggagtgtgaacagtaacagggctgctgaacagccacagccagtgcacgacacaagtgagaatgaacctgtgtcttggaggtgctgcagtcctggtgccattttgtcccgcagcaaaagcagctccacatacctttgattgttcccttggcctctcctcttttcacttgtgcatgattctctatggggtttctgtttcctttctttgccaggtacttttacatgtgctgtttcctttttctagaattagctgtcctccaaaacctgtgactgattattagggggaagcatacaaaactgtcattgttgcagatagaaagtcatcaaagtctagcagtttcctaaggttaacataactaaaaacaacaatggcagcagccaggcattgtgctgggaactgggttccactaacccctcagctcctctcattaagcttggaatgattcctaaccccattacgaagatgaggaaatgcgaggctcaggctcatcaagtcacttagctcattagtggtggatctagactccaaatcaggctcttaattaggaccctctattgttcaacgttttccctcccatgcactcttctcttctctggaggggctgctggagattcctcgtgacagtacttgttacagttcccattacctggaggttatattcatttgtgctcacaatggtgaagaagcttagccaagcatgtggtatgtattattcttaatcccattttgcagatgaagaaattgagactcagctcatgacagtgctaactgcattgcacaaaagttgcctaaatcaccaaaataagcaggtgcggttctagggaggagagctgaggagactgggttgttggctttgtgaacgcagtgctgtggcttgcctacagactaatgacctgtcttttaacaggactatacaaatccagtcagcctcccaatctaaaatgtcacactcaaggttccctctctcatcccatagagttgcaaccaatgctgctgaaaacatcatacctcatgatcaaaggcataagtccttagttcaggaatttcaaatattttagcagataagcagtggtattttggagactattaatcatgaaaccaaacttcctgaccaaatcttatatctggtcaatgtttctagaagccaccaggctgggtttcaagtgaagacttactaatttacaatcgcaaatgcagcatctgctgttcaaatgggtgggttttttttgccagaggacattccatgtatttagtgatataaggtcctagtccactgttagccacttatttattttctacactccttttcatctgttcaacctcagaagaatctgaaacgtccccagcagttgtggaatttgggttattcaagtggtgcccaccaagtgccaagtccattctagctacaggacttaatccccgcacactcccaaattcaaattccacctggcacacttaatgtgtgtgcttatcttgtagtactcacaccgatccatgggagggagagaggttaagtcatggaagcaaaagctctctcagaagagcatgcatcccaacttcaaaagtagaaacagagtgacgctgtaccttttttcctcagaaatgttgaagtttgaacaaaatgaatctttagtatttttaaaattgacctgggccaggcacggtggctcacgcctgtaatcccagcactttgggaggccgaggcaggcaactcacctgagtttgggagttcaagaccagcctggccaacatggtgaaaccccgtctctactaaaaatacaaaaaattagctgggcatggtggcacatgcctgtcatcctagctactcaggaggctgaggcaggggaattacttgaacccaggaggcggaggttgcagtgagccgagatcatgccactgcactccagcctggatgacagggcaagactctgtctcaaaaaaagaaaaaaaaattgacctgtcgtcagaattttaagtcaatttttgatttaatattatgttgatgatcttgtggagaaatgtttaaaatagaaacaatataaaacgccaaaaataataaaaggaaacccacacttcattgatataaatacgttttaaattttaggatacaatcgccaattcctgattcccagtcaaaaagattaagtagatccagatgtcacagatgtgaatccacatgtttacatcacatcttgaaaacaatcattattttaatcctaccaaggtataagttgctgtattagtgagagactagttttgtgtagaatgacagcagtaaagacggcagtgaaacaaatgtccatgagctatcttgaatttgtattgactctccccaaaatcttaatgatttcagctcattgaggaaattttcctagtacatacccttctcctggcataaagttttcctagagagtctgcaatttttaggtaagaaagaatattaataataaaaaaggaactttccactgatctcaagtttgtgttaatatgatgttcagtctaactccaaactcattccccagcaagaccctctttaaaacatgtgtgtctccccatcctcgtcatttggatttttctccattatgggtgccatctgtctgtaacatctgtcatccctttgattgccaatgtgaatttcgatggtctggctggtttctttctctcttgcatatttctgactacctgtttctcttctcacccaaagaggtataactccacaaggacaaaagttatggaaactatattttcaaacctaaaatcacaacatccatagcatgagaagtatgcctgtacttaaacatactatggggcaaaacatttgaactgtctgaagcacctaggatgcctggtcatcagcctgaagaagacggatggtagacatcagatgtctttctagcaccttcttgtccggagcattgtatcttcaagcaattgttacacttgaatgagtgactaagaatttaaaaggcatttatcattggtgagacttttgaactagtgtttaacattcaaattgtgactatatatatatatatatatatatatatatatatatatacacacatataattttttttttttagatagagtctcactctatcaccaggctggagtgcagtggcacaatctcgactcactgtaacctctgcctcccagattccagtgattctcctgcctcagcctcccaagtagctgggattacaggtgcacaccaccacacctagctaatttttgagtttttagtagaaacaagattttgccatgttgggcacgctggtctcgaactactggcctcaagtgatctgcccacctcggcctttcaacaaagtgccgagattacagacttgagccaccatgcctggccaatatttatcttcttaaaagtctatttctataagcacacagatttagccttctctgttggtgtcatcatcttcagtcagtggagactgtgcagaacccctgggattagggactgaaagagccaatgtcagaatagagagtgggacagagtaagatagcccttctctcctgatttgggcctgctcattgaatcccaatctaaagtggaatggaataagactgctgggtcccatttcaataagagtctgcctcctagcgcagagactatttggaagccacagccagaagccacttaactgagcagcaagcgctgccacagtctgcaatcagcagtcaactggcctcacctatgggcatgcgattccacagccaagactccccagggcataatgtccagccccatctctaaagctacaacagtgggtacaaaaagatgttgcaccatgatagaggtcaacccactgttcaatgaggacaaaagcaatttggcaaagctggcaagtgcagataagcgtggctccagagagacaaaagctcagtctgttttgcttctcaatttgagcaattagcgtcctacgcaatacccatcaattcaaaagctaggcaacgtttctggaagaaatacatttctaggaaagtagactatgaaaatgtttttagaattgttttattatgaattctttttttaaacatttcttgataacagtataaaaacctagtcatatcttaatagttatctaattagctaacgttattaaagcaggagttgcatgaaatagaatcagaatttagtatcagaaaaaaaaacacatgagagttgtatcatgacaaatttctccctgaatgtttgaaattgctcccactctttcaggtacacgtatcacagattcaaggaacagaatattctctgaacttgagaaaaagaaaagtgacttttcattgtcctttcccccattcagaagcaataattacacccaggatacaactgatcttcccacagctggcttcctgagtgcgtgattagctacaaaccttcctacctagtgggacgtgggaaaatgaaatagcaggaagatggaggctgtcattttgctccttggggaatgaagtgtgaaacctgtgggaagttgagagtacactcagagcttagttcccatgcccaagaagataagtacgtccctgaatctcctgaagcaaaatccttcattggtgtattataaccaggcctgcgtggcttgggttagaaaagctgtatttgggttcctattactggtgattgaaaaatctaaacctaaacctgctttgcatcatcacgcctgaactacaagttaccgctgagcttaagaacattttttacttcatttacttgtctggaagcaaaatggttctgaagctgttttggaaatatacaagtatatctatctccataatttatctatctatctatctatctatctatctatctatctatctatctatctcttagtattcaaaatctcaaccaaacagaaaatgcatttgtgacttgaagcagacggagacacccccagccccacccacctactgatgttgcttcattgggaagacaggcaatgcaggaggagttccaaattaccactctgggttgaaagggtctcaaagtcaggcacacaaatacaaaataaaacatctttgcaagttattgtctgttcagagtgcacagctaggagaaatggaaaacaggcattcagtcctctactcctcctcctcctccatctgtcttcccctttatcagttgattggccatgtcaccatggcatctaggctctctgcaggatgaagtaggagaatatgcttataaggatggagaaggcctgcttgtccttgcttcctttgtgatctgaggagaaagaatggctccactgcctgcaactccaacagacagaacagaaataatatccaggtagacaagaaatgaacagtcagcccgttaaggtcaggaaaaaccatcaaagacaaggcgtcagatattcatggaccatacagcattcatgtgtccttctgacatcacgagttcaaacaagtgcttttctttttcatcaaacttttaattttgaaataattgtagatttgaatgcatttgtaagaaggaatacagaaagaccctgaaccatttactcagttttcccaatggtaacaacttgcacgatgatagtacaatatcactaccaggatattgaaattgatgtaatccatcaacatatgttgtgctttcaaaatcagtttaactgcttgaaaaagtagcatatccacagaaatacctcaggctggataaacaggcctgaaggggacatgttgtatatttatgaacaggctgctttgtctggctgagggaagtgtggcaggcatgggtaaatcattgaatcatgggttctttgaactgatccaacttctctctcactgacagcacttactgtggaggaggaacttttttgcattttgtttcaatttaggatttcctaaaattaagatgagagagtgtccagaagggtatataccaatcacaaggatgaagaacagaaagatgaaccttctgatgtgaaactttagagaagagagaaaaacttttatcatgcagtgggagaagtagaggatcaggaaggacaggatagacagcaacgcgctgatgggtgcacccctgccaggaaccctgctgccggccactgtgtttctcatttgccgggtgtgcctccccagagagaaaatcaagagcaaaacagcaaaaaggaagataagcaatggcactgagaactcagcaacaaaagagaaaatctgtatagccagtgtatcttctttttgaattgtggcattttgggagaaaaatttccttaggaagtatgggaccataaaccctgcatatttgctatggaaaacacaaatcatagatacatatagcagagaccccaggatcatccatgggaccagcttggatatcctcatcttcaaccagatgaagagtgggtgacggacgctggcaaccttggcacaatagaaaacgccgagccatgtggcaagccaaagttccaattcatttataaataagagaattgcacaattcgcagaacacatgatgaattctatgaagaagataacaatcacattaacgtagaagatgaacaactgcagaaaaattctagaaactgccagacaagaaagaaggagatccagcggagccatttttctgtgcttgatcaagtcaatgccattcaccaccacaatgatgccatttgtgaaaatcccaagaagaaattgtatcactgcaagaagaaaatagataatgaggtgagactctagcattttaggaataaaaaattatttacttaaaaaataatgaagttataaagttttggacaggttgggttgttcacgctcttcaattagatcaggactcctctggggaagaagactaacaataaaggcatggggcaggaaggtggtgtacatttgtttatgtcactgctttctctatttagttctgagacagtcaaataaggaggagatactctagcatcaatttgcttcttattgatggcttttgcattttacaggtttacctagctttcaaagtcatcacaggcaaataatggaatcagacaccttcagacagctgggagaacagctcctccatagtaattagccaaagatactcaattcttcatctctactatgaataattgattttgcctacaggtgtgattctacttaatgttatcgtgtactctttaaaaatatacatttttgaaattttcacttatgttatgatgatatggtacaaccagcaacataggactcctgagtagttctccaatatgcaatggttgagcaattcaaaactatctgtaaaatagttatagaataaaatatacataataaaagtatctctaagtataaaatcaaagtaattaggcttgcacatacatgtgtacaccaggtcaaaggcctaaagaaaagtaaggtgtaatgaaatgaagacaagcactcagcactgttcaccctggtcagcatctgcagagtaattcaggggttaaaatcttttctctcttatttttccaaaattatgagagttttatgacatgagctagttgttctagtagaaaagtaaagataaaataatacatgattaaatttgttgctttcagtctgtaatgcactatgaaaaattaagttggtatttcttaatatgtataccgtgctgcctgtaatgctgaagtgggttttctcagtctttacattattgacattttgggctacataactctttgttaggcacgggctgtcctgtgcaatctaggaaatgcagaatgtctaccacatgcctgtcctctacccaccagataccctccccaggctgtaacagccaaaatgtttcgagacattgccaaatgttcaagagtggcagaaccactatgacgggacaaaggtagataaagtatagtttgtaccttccagttatcccaagactaaaggcagaatgagccacatatataatgtgatataaaactaagtcctctctctctctttagagacagagtcttgctttgtcacctaagttgcagtgcagtggtataatcacagctcactgcagcttcaaattcctggactcaggtaatcctcctgcctcagccttctgagtagctaggactatagatatgcaccaccatgcctgactgctttttaaaaatttttcatagatatggagtcttgctacatagcccaggctagccttaacctcccgacctcaagcaattctcctgcctcagcctcttgaggtattaggattataggcatgagccaccactcccagccaagttagttctttagacaattcatcaccagagcacaaagtggggaccaattcaataaacactgggggaattaaagcttctccaacttagcacttaatcaaaaggtacctggcagacctgataatgaagcatatgtcttaatgaacgtgtgttactttgtctaaatgtgtcataaagaatacttaagattaatcttatttttagaaaactggaagggaagtcatattttaaaaaattagtcgtgagagtaaatctgtaggttcttttatggctcttctctgaataggaccatctatgccatcttggactcactctgttcttcctgacacaactacagtgagatgaaggaaagagacaggatcatcttcaaggaagcaccaagggaggtgttcatgagcagatgccatcagaatggatccaaatgcaagcatgccaggaggatgagccttgttttccctccagtagaaagaagaagaaactttgcaacttagaagaaacattctgcagcttagaaaaacagaaatgtaagggcatgcagctatgaaatacaagcatacttccataatactgtgcattaaattctagaccaccaaaatacaagaatattgcaataaggccagtcacactaatttgttggttttccagtacatataaaagttatgttgatactaaactgtggtctattaagtgtgcaatagcactatgtcttaaaaaaagatatacatactttaattgaaaatactttattaccaaaaaatgctaatgatcatctgagctttcaatgagtcataatctttttgttggtgtagggtcttgcttcaatgttgatggctgctgactgatcaggctggtggttgatgaaggttgggtggctgtggcaatttcttaaaataagacagcaatcaattttgtgcattgatgaactcttcctttcacaaaagacctctctgtagcatgtgatgctgtctgacagcattttacccccagtagaactttcaaaactggagtcagtcctctcaaaccgtgccactactttattaactaagtttatgaaatgttctgaatcctttgttgtcatttcaacaatgttcacaacttctttaccaggagtagtttccatctgaagaaattatttgctcatctgtaagaagcacttcctcatttcttaaaaacatcatcataagatgacagcaattcagtctcatcttcaggctctacttctaattataattctcattctatttccaccacatctccggctatttcctccactgaggtcttgaacccctccaagtcatcaggaggtttggagtcaaattcttttacactcctgttattgttggtgttttttttttaacctccttccatgaatcacttcttagtggtatctaaaatggtgaatcctttccagaaagttttcaatttactttgctcaggtacatcagagaaatcactgtctatggcagctgtagccttatgaaaagtattttataaataatgagacttggatgtcaaaattacttcttgatccatgtgttgtaaaatgaatgttgtattggcgggcatgaaaacagcatagatttccttgtacatttccatcaaagctcttaggtaactactcttaggtaactagatgcattgtcaatgagcagtactattttttaaaaacgatttttttctgagcaataggtctcattcattttttatggctgagtagtattccatagtgtgtgtgtgtgtgtgtgtgtgtatattatatatatatatatatatatatatacacaaatgttctttatccactcattcatcgatgggcatttagactggttccatatttttgtaattgcaaattgtgctgctataaacatgcatgtgcaagtgtctttttcatataatgacttcttttcctctgggtagatacccgggagtgggattgctggatcaaatggtagttctacttttagttctttaaataaactccatattgtttttcacagtggttgtactagtttacattcccaccagcagtgtaaatgtgttccctttataccacatccacaccaacatctattattttttgatgttttaattgtggccattcttgcaggagtaaagtggtatctcatagtggttttaatttgtgtttccctgataattagtgatgttgagcatttttttcatatgttgttggctatttgtatatcttgagacttgtctattcatgtcctttgcccatgttttgatgggattattggtttttttttcttgctgatttgtctgagttccttgtagattctggatattagttctttgtcagatgcataatttgtgaatattttctcctattctgtgggtcatctgtttactctgctgatttatttactgtgcagaaactttttagtttaattaggtcccatctatttatttttggttttgctgcatttgcttttgggttcttggtcatgaactctttgcctgagccaatgtcaagaagagtttttctgatgttatcttctggaacttttatggttttaggtgttatatttaggtctttaatccatcttgaggttgtttttataaggtgaaagatgaggatccagtttcattcttctacatgtggcttgccaattatctcagcagtatttgttgaatatggtgtccttttcccactttgtgtttttgtttgctttgtcaaagatcagttggctataagtatttggctttatttctgggtttgcttttttgttccattggtctatgtgcctgtttttataccaataccatgctgttttggtaactatagctttttagcatagtttgaagtcaggttatgtgatgcttccaggttttttattgttgttgttgttgcgtagtcttgctttggctatgtggtctcttttttggttccatatgaattttagtttttttctagttctgtgaagaatgatggtggtattttgatgggaattgcattgaatttgtagattgcttttggcagtgtggtcattttcataatattgattctacccatccatgagcatgggatgtgtttccatttgtttgtgtgatagatgatttctttcagcagtgttttgtgttttaccttgtagagatctttcacctccttggttaggtatattcctaagtattttgggtttttgcagctgttgtaaaagggactgagttcttgatttgtttctcagcttgcccattattggtgcatagcagtcctactgatttgtgtacactgactttgtatcctgaaactttactgaattcatttatctgatctaggagcttttttgatatgtctttagggttttctaggcatacaatcatattactggtgaacaacaacagtttgacttcctctttactgatttggatgccctttatttctttctcttgtttgattgatttggctaggacttccagtactatgttgaatgaaagtggtgaaagtggacatccttgtcttgttctagttctcagggagaatgctttcaactttttctcattcaatataatgttggctgtgggtttgtcctagatggcttttattatcttgaggtatgtcccttctatgccagtgttgctaagggttttaatcataaagggatgctggattttgtcaaatgtttttcctgcatctattgagatgatcatatgatttttgtttttaattctgtttacgtcatgtatcacatgtattgacttgtatatgttaaaccattcatgcatccctagcataaaacccacttgatcatggtggattatgtttttgatatgctgttgaatttggttggctagtattttgttggggacttttgcatctactttcatcagggatattggtctgtagtttgctttttttgttatgtcctttcctggttttgacattagggtgatactggcttcacagaatgacataaggaggattccctctttctctatcttttggaatagttttagttaagattggtaccaattcttctttgaatgtctgatagaattcagctgtgaacacttttggttctggacatttttgttgtgattttttttttttactactgtttcaatcttgccacttgttatttgtctgttcagtttctatttcttcctgacttaagctggagaattgtatattttatccatttcctctagattgtttagtttatgtgtgtaaaggtgtttatagttgccttgaataattttttgtatttctatggtatcggttgtaatatttcctgtttcatttctaattgagactattggatcttctctcattttttcttggttaatctcactaatggtctatcaattttgtttatcctttcaaagaaccagctttttgtttcatttatcttttttgttgtttttgtttcaatttcatttaattctgctctgatatttgttatttcttttttttctgccaggtttggggtttgtttgttcttgtttctctagttccttgaggtatgaccttagattatttatttatgctctttcagactttctgatgtaggtatttaatactaagaactttctcataacactgcttttgctgcatcccagaggttttaataagttgtctcactattaccgttcagctcaaataattttttttaatttgcatctcgatttcattgttgacccaaagattattcaagagcagattatttatttccatgtatttgtatagttttgagagttccttatggagttaatttccagttttatttcactgtagtccgagagtgtacttgatataattttgattttcttaaattatattgagacttgttttgtgacccatcatatggtctatattggagaatgttccatgtactgaagaaaataatgcatattctgctgttgtttggtagaatgttctgtaaatatctattaagtccatttgttctagggtatagtttaagtccattttttctttgttgactttctgtcttgataagctgtctagtgctattagtggagtattggagtccctcatctatctcatttcttaggtcttgtagtaattgttgtataaatttgggagctccagtgttaggtgcatatatatttaggattatgatattttcctgttagactatccatttattttatcattatataatgtccctttttgtctcttttttactgttattgctttaaagtctgttttgcctgatataagaatagctactcctgcttgcttttggcgtccatttgcatgggatatctttttccacccctttaccttaagtgagttcttacgggctgggtgagtctcttgaagatagcagatacttaagtggtggatttttatccattctgccattctgggtcttttaagtgaagcatttaggccatttacattcaatgatagtattgagatgtgaggtactttctattcattgtgctagttgttgccttaataccttgtttttttttttccattgtgttattattttataggccctgtgagatttatgctttaaggagattccattttggtgtatttcaaggttttgtttcaggatttagaactcctttaagcactttttgtagtgctggcttactagtggcaaattctcttagcatttatttgtctgaaaaagactttatctgtccttcatttatgaagcttagttttgctgggtacaaaattcctggctgacaattattttgtttcaggaggctaaaaatggaaccccaagcctttctggcttgtaaggtttttgctgagaagtctgctgttaatctgataggttctcctttaagggttatctgatgcttttgtttcacagctcttaagattctttcctttgtcttgactttagataacttggtgactatgtgcctaggtgatgatctttttgtgattaatttcccaggttttctttgagcttcctgtatttgcatgtctagatatctaggaatgccagggaagctttgctcaattatttcctcaaacaattttccaaactttcagatatctcttcttcctcagaaacaccaattattcttaggtttggccttttaacataatcccaaatttcttggaagctttgttcattttttaaaattcttttttctttgcctttttctgattgaattaattcaaaaacatagtcttcaagctctgaatttctttcttctacttgttctgttctatatttaaaattttccagtgcattttgtatttctctaagtgtatcttttatttccagaatttgttagtgttttaatgatacatatttattttgataatttttcatccatatcctacatttttaaaatttctttaagtttgtcttcacctttctctggtatcttcttaagcagttgaataatcaatcttctgaattctttatctggcttttcagagagttcttcttggtttggatccattgctggggagccggtgtgtgtgatgttttggggtattacagaaacctgcttgtcatcttaccagaattgcttttcttgttccttatttgggtagactatttcagtggagaggtctaaaactcaaggcctgctgttaagattctcttgtcccatggggtgatccctcaatgtggtgctctctttctttccctagggatggggcttcctgacagctggactgactgcagtgattgttgttgctcttctgggtttagccacccagcaaggctaccaagctctgggctgatatcaggggatgtctgcaaagagtcctgtgatgtgatctgtcttcaggtctcccagacatggattccagcacctgctctagtggaggtggcagggaagtgaagtagactctgtgagagcccttgattgtagataggtttagttttctggctttcttgaatgctggttatactagcagtgaagttgtcatgtggacagactcagggcctctgcttagccaggatattgcaggcagtggaattaggtgttgtcttctccttcctggggtcagggttattctgtcctgagttgctttaatgacctgagttggttgtcctccagccgggagatggcactttcaagagagcaccagctgcagtagtagcagggggctgtaagcttgccctaagatggccagggtaattattttggtttctcatgtgatgtgtggggccataaagctcccaagaatttctatgtcttgagtttggctaccagggaaggtagggaaataccatcaggtggagtcagggttaggtgggtgtgggctcagactctccttgagtggggcttgccacagccactgtgggggatggaggtggtggttctcaggccaatggggatatattccagagagaatcttggctacctctgctgtatcatatagttcaccagggaagtgggggatagccagtagcaagaggcctgacccagctcccacacagttggtgaggctggtctcactccagcagtgcccccgctcagtgcccaagaccatgcgcaccccactgggaaagcaagcatggctttcagacctagcccctctccactgcccgctccattggcagcagctcctgtgcttgcttgcttatgcctgcagcagctcccactcacaccccagactctgctcaagaaaatttgtgcccagtcaaaaccattaccaatttctgatgggaacttccttcaccctgtgacccctccgcagttgtattggctggcttccccaagggaccctgtgagatatactcaatgatggcttccctgggctcaagctggagactgggagtgcatgcaaggtactacccgctgctacttctacttttatatttggcacaactccctaaaaccattttatccctaggtaggttaaatccttctcctgtgatctggattttcagattccccagtgggtatgtgtgttcaaaggtaggttttcctcctatcatgctttgggaactcacagttttttgcctgttttgtggaatttgcagcagcacgccactctttcaaaggatctgtgaattattttggttttcctggcatgttcctgcagtggttcttggagcaaaagatcatgatgtgagtctccacacactgttctgccatccatgtggaagatgcacattaggccgttctctgccatcttcccccgatctccaaccttagctaaatcttctgaattgctgcagcttctacataagcacttgctgctttaccttgtacttttatgttagatggcttctttccttaaacgtcatgatctatcctctgctaacttcaaacttttcttctgcagcttcttcacctctctcagtctcatacaattgatgagagttagagccttgctctagattaggctttggcttaaggaaatgttgtggctggtttgattttgtatgagagccctaaaattttcttcatgtcagcaataaggctattttattttcttacacttgagtgttcactggggtagcacttttaattttcttcaaacagttttcctttgcattcacaacctaagcatttggcctatcatggctctcaacatgcctttctcactaagattaaccatttctagcttttaatttaaaataagagacaggcaactcttcctttcacttgaacactcaaaggccattttagtattattaattggcctcattttaatattgttgcaagtcagggaatagggaggctcaaggagaaggagtgcaatgggacagccgggtagagggtcagtcagaacacacacaacatttatcaatcaagtttgccatcttgtttggacacagttggtggtgtccccaaacaattacaataggaacatcaaagatcattgatcacagatcaccataatgatacaaaaataataaaaaaagctttcagatagtgaacgaattaccaaggtatgacagagacatgaagagagcacaagctgttggaaaaatgaccccgataaacttgcttgacacagaattgccacaaaccttcaattccttaaaaaaaaaaaaaaaaaaaaaaaaacagtacctgtaaagcacaacaaagtgaagtgcaataaaataaaatgaggtatgcttgtagggaagccaagaactctcagaaaagcagttactgctagttccttggtttctcagtcaagcgtctatcactgcacctgtcctttctattgcaaatcttggttaacccacctgcgccctgcaacactcagctctgagaagcagatttgtgctttcttctcatcctcagtactcttcattcattaattcacttggtgtttaacataaggtgggtgtgttaagtaaaaccagactcaattatgtaagggaggaaaagaaaaataaatattaccagaggaaaaaaataaatattagcaagccacttagaaagacagtcattgttttctagctctctcttcctggagaacccagaccatgacaccagcatggagttcatccctgtttgctgtcatattgccatgacatttctgtactgatcccgtggtgtgcgccttcagcaaggtcctggcatttcagtattgcaagaaaagtaacaagaacactaaagtgggaaagtgaaaaaaaaaagttcacatcctgagtctaggatagcaatacagtttttcggccctgacaggaaactagcagagataatacatattgcaccaaagacttaaaagaaataacgatgtccaattctatttattagcatgctatttgtctttcggattctaggatcctgaggggccatttggttctcagatattctattacaacttttgttttaactagcttggggagcagagacaattcttcatagagaactttattttgtgtagaataggtcttttgatatgggaatcccatggagtgaaaagtaaaaattcataaggcttgtgctacatttttttcattacataatttctgtcactgtctcttccatgggcacacacagagtctgccaaagattcaccgttcctcactctcttgagactcactcttcttaccctggaggatggaaaaataagagacgtctgtctgtaggtgtgcagcattcatgtgactgctaaactaatgtccccttttgcttcctgaatgagcctcctttcagtgctggggtgaagacccccaaggacatgttctccagccttcctctgaatctactgcatcaatcaagccacagatgttggtcatgctcttgcactaagcaagagtgaactaaatattttaacactcaacacaacaaatacaatttttaaaacaatggcactgagtataaaatccttttaggtctttaaacagtttgttttagtgagaagggcacatcagagaatttctggctctcagatgaaaaacgtatatgtctggcctcacctgtcagtcagtggcttggaacgttgacagttttacatggacaaatagcttggaacagatgggacaagacctgatgtggagaaattcacatgattattaccctgtattaccctgattaaatccattcacttgcactcatcttaatgagcaatcattaaaggagacagcactaaatattcttgaggtaactgacaggcggaaagagttgcttatttatattcaaatcatttagctcctcaaaagaaagtgcgatttttttcacatgcagttagattgacgttggaaagcttttcatcaggtagaaggctgtaatgttcatctttctgctttccggcggcacttggacatttgctttggtattagaggcatcatgaaagtgagtggtggttttaatacctttcccaagtgggccctcacacttcattatcaagggaacaattcctgctttaagaaacatgtgcatgtattaacattgttgtatatttaataagatcattcaaataaggaagaaatagactctgagcaaaccaacccagacatcctttctgaatcttcccgatagcagagctcggcccttgtaaagcctatttggaatttatttcatttaaaattcacaacgtcttggttaaaaagcaccagattctttcaggctaatcattcttcagatccattcatttgcttctctccacttgaatttgcagttgatcttttagactaaaatttttgtctttaatattcaggtcactttcatatacttgtcccttcccttgctcaatttattctagtaatatatttctgtgctttttcttactccactcaatattctgagatgtatttgcaatgcagcaaatagaataatggagcaatgcaatacattgaatttaagtcttccacataaagaactcaaagtgctttacaaacaagaatcccttgttagttacaatgaggaaacagaagccacagatgctgcagttgaatcatgggaatagtctctagtcctcacgattttgtcttcagctctaaactgagttcctccgtggaatttcaaatccttccttgcttcttccctccctccttctctctttctttcccttctttcctttttccttctttcctccctccttctttcctttctttcctttttccttcttccctcccttcctctttatccttcctctcttcctccttccctcccataccccagcacacacttattgtttgtattatgaactaggcactgttctaagcacacagcatttacagccatgcactgcttaatcacagggataggggatacactgtaagaaagtaatcgatagacaattccatcactgtgcaaacatcatagagtgcacttacacaaacctagatggtatagcctactacacacttaggctgtatggtatagtccattattttgctcctaggctacaaatctgtacaacatgttactgtcctgaatgctgtaggcagttataacacagtggtaattatttattatttgtgtagctaaacatagaaaaagtacagtaaaaatagggtacaaaagttgaaaaatgtcatatgtgtgtagggcaattaccatgaatggagcttgcaggaccggaagttgctctgggtaagtcagtgagtgagaggtgagtgaatgtgaaggcgtaggacattaccctactatacactttataaacattatacacttaggctactctaaattcataaaaaataaagtaattgtgctaggacaatacaatggctttgatgtcactagctgataggaatttttcaactccattaaaatctcatggaaccaccattgtatatgcagtccactgttgatgtaaatgttgttatatggtgcacgactgtagtaatgaacaagacaaagcttctgtcatcttggaaatcacactgtagtggggaagaggagagttaaacaagtgaagaaataaataattccaggtaaagtagaaagaggtgctattttagaaagtgtggtcaggaaagcctgacctccccagagaggaggtgataaaagacctggatggaagatctgggaatgaacacttcaggcagagagaggaggaaatagtatcctcactccccatcccatcaataaaagagcttgcagcattccaggaataaacaatgcccagcaaccctgcaatgtgtggggcagtatgaataaggcagagcagagaggaagttagaggggaaggcatggagactgcatctcaccctcaactgaatgggaacccattgaagtgtttgggtgagggggaagctttgttataatcacatttatatcctacaacatttactctgactgctgttatttaaagaaaggcatttactctggagaacatatgtggaggttgggagaaggcaagtgtggaagtagaaataacaactaaaggctgttgcagtagaccaggcaaggcatgttgttagcttaaattaggttggtggtcaagatgggaagaagtggctggacgaggaatagattttgatggcaacaccaacaggaaattcagttggctttgatggggagtgagggaaagagaggaatcaagaaatactcttgggtcattggcattatcccctggtgagcaatggagccatttttcaagaaggagaaggttgaaggaaggttaaaatcaagagctctgtgtggacatgctcctgagacggctactgcaggtagagatgatattatgtcatggatggtaagtttggagtttgtgggaactatcaagtttggaaatatgcatttggaatttgctagcatatagaggatattgaaagccatgaggttggttaagattatgtagggatgagattgccagctggagtatctgagcactgtaaataagaaaccacattttgtgcattcgtgtcacttcgattgtcctgtctgatgccatctctttgtggaaggatgccctgacgagagcagagtaggtgagtcagagcttgcattactgaaagcaattgtggaactagtactagtcatggtttcctaatctctttatgtatggctgattttatttgctgtttcatttagaatttttcctccttctaaggaagattggtctgcagatttttattggtgctatatttaataaatttgattatctatgttatgctggatttatcaaaagattgttaagcttttcttatttctatgcaccagaacaaattaaataacatgggaattatctgtttatttgttggatggaaagaattcacagtgagaaattctggtgccagaggcatttgggaagaggcagaatacttaccaatcatttagtgcttacaacgctaaacaattgaaaggcataacatcaatttgtcctcttgacaattttatgaaatcagtattctttccactttagagattattaagttgaggtgcactgaggtctggaaattgccctcagtcatgcagctaaaaagcagcatttccaagttgtggaccacaatctgatttcaaatgctatgcgtgcatttagccattaagcatcaccgcgtcctatgttaatacccacagtgagagtgaagattcctttcagtggttcaggcataaaatttggacagctgccatttactgcccatctggcatttgtccccttgcctttaccctgactttctttccaggaaccactctcctccacccttgtttatgggccttacttggggctgactccatcactgaatccaggagtagtcacagaaacccaggtgtggcagtcaacatatccattcacctgagcaaaagagatatatccagggataaacatgagacccaaattcatcaagtcagaactaatcccaaaacttctcactgggcaggctctctgcagacaggatggttgcctggcatatccatcttgccaccatgagagaaggacttcagcctgcccaagaatggattccatccagaggacaaaagtgcccagaaaagagaaagcaagaccatgttctcctcagaatatgtcagcctcagaaccagccctcacttactgctggccttgacatttaaatgaacccacaaattctcagttgttactgaagtgggcttgagacggttttttgtcacattgggtgtgctgaaatagttgtggactattatagaaaggtaatgatgtattttctatttctcatagttagtaactggaaccagacaaattatctgcctaaagccagtcatttagtgaagtaactagggcccatacctgtgacttgtatattagagttttgagtattctattcactagatcatacagttttctcaaacatatctgtggaagttacttagaaaaaataaaatacaaatttcttttctggattctttccctatacatttagttattcattttccatcacttagttactctgacggctcagattttattgtgctatagaagagttctcaaagcataaggttaccatatgggcatcagaagttttattcattccaaaccgaacagaatgtctttggcattgactggctatactttgttcaaaagatgcatggtcaaatatattttcatatgaatttgcatatatgtggctgcacaaccattggattggacacatggaagatgataatgtgtgctcttgaaacaagcagtgccatttctgccctggtccaaactcaaatggttctcttttgtcgtaggagtcaaatttatttttcctgcccttcaaagatacaatacttccttacaaattacctcgcaaggatagaactgggtatttcagattttcatatatagaagctgccctgggtcttgctgctgcctctccccttcaaagcagctgtctccagatacaggattgccagcttccagaagaccaaaattgttgtgccttgctttgattttccagaatgtgggaccagcctttgtggttacttagttcatgtgttttggggaaactgaagctatctcttgcacccaggaatagacataaatgtgtgggtaaagatagggatgctctagaaacagctgctgaactaacaatgaaaacaaatgaatacaatttctcatctttaggaagtcattgctagccaaactattactatgcaaactatgtaatatttgtcatagcgtataaaatattattccatctacccatatttgtggacatttgtagcaaataagtggggtaaaggatagggactgtgacaatgatatggcatgaatctcactgactcagaggaaatgaaaaaccatgaactcggctttttaaattcaatacagtaaacttaatacagaaccacatcaaatcagatctgtaaaggatattaatgattatttgtgccaactccttaccatatgtgaaaagagaaaatagaatcccaacaaagatgcataagaccctgtaccttgacccaaggactattcagatgtcttgcattctagaaaaaagaatattgtggatttatttgctttagttttgaccagcacagcctccacagaagcatagtccaactcagtgggtggatgttatccacagtggcagctgttatcaccccaaggcaaggctagtgaccatgcttttgaggagagctgtgcaaaccccacatacatacatttgaatctcaccacagttgactgaaaaacctagatataggagtctgcacctcctcctcaaaatgtgagaaaagtaaaaaacatttagcaatggtactcaaggtcctccagccacgtgaatagagcaaaattggtccaatatattttaaattacaatagtagtatattagaaagggaaatataagggaaacttttagttataattttctgtagacattaatatttattcttgtatacatcagactttctacagatagacgccatgataatatagaagattcattttatgaaatattctttctcaattattcacaaatctgaatgttgtcttgttatcgttaagtacataatatgaatttattatctattctccctgcctggcatgaaacatcatttagataatcatagattctactgaagaggaagaaatttgaataatgttaacaagcaattcatggtggggcttttagtcaactttatttttctagttcgacttaacatagtgattcacaaagcttacttcctcctaagaattcacataaccatgaaaaaagtacttttggccataaaacaggatgagatcaaatgtatctcaaaagcaactattgtcagctatattcaaaatgcatcattctttgatctaaaatggagaaagtaagtgtggccatggctacacagcagtatggattggggagagaatacttcaacatgcaagagaaaaatgtgatcttaattatagggacttgtaattaatgcatttcaggcctcaacatttaagttgcattttggtaacttttaagtaaataaaaattttaaatgaataaataaagcttttaaatagtttttaaataaataacttaaaactaagaaatctgtttttatgccttttttccaatctatcaaattgacaatataacagatctgcattgttcctgcatcatttcaggtggcctgaaatttgacaagaagaggacatatgaatgtcttctgtaaggttagatgaagatcccaatgcactgagtcaaggtctctgaatcgtggggaacatgaggtagttaccccaagcagaagcagaggccacatccctcagctcggtgtccagtggccccacattcattcatactgggagatagcagcaaggaatgatactttctttgcaatacatggtactgtcgaaatgaaaaactcaataatcccttacaggatctccatcatttttttcgggggtggggggtagctagggacgtatagactctatactaacaatcttggcccttaactagaaatatcatggccgaccagtgaccttttggatacatatggacctcaagccaaatacagccacagcaaggccacaggctcatgaagaggaagaaggcagggtcggtgcccaggcatccttcgagaagctctgtctccaacttttctcatctggaaagcccctcttccttttgctcattgcaaaatctgacttaacactcttttatctggcagtgcttaaagtgagtttgacctgaggtccacaattgctaattgttgaaagagaactagaaacacttgcttaattccgagggtcaacatcaaaaacaaacctgaccaaagttgcagaggaggtattttacaactaacaacaaccttaacctgacttcgtttatcaaatgtcctcagaattatgatacacccagatctttggcattgtatttttttgtccaccgaacaaaaccgggaagctaccaaaagtcatgcatggaattcatgtgtaccactagcagtgtgtgagatcagcagaatgtttctgaaagctaagagctgtattcaaagaactgatcacaattgcatttgaaataagttatctgccactatttcttttggccataatgtggcaaatgttatatagacaagaaaatatttagtaaaagttggaagtatttgcaaaatatttgtgcagaagtttgcatctttaattgtatgacctcattgtagttgcacagggagactccagctacatcttatcttttcaaaatactcctgagcaatggctttcctacaacctctttggaatgtagcattatcagcttctatttccccaatttcctataattcaataaaaagtcagcaataacatgtccaagggcatgttatctcaaatgtggattttaatgaaacacaaatatgcccatgcatgttttagcaaattgttctggaccatgcaaaaatgcattaaaagtggaggcatatttacatttgttttgcatttgttatttaagaggtcagactatgcaaagtgcatccacttttgtcaatagcttcaaggagaagaaaattttattaaagttagattcatgacaaacagatgagttaatatctgtcatttgggggaaaaggttttgagaggctacatttttaaaataataggcatttattacttttccaaaactgagaatacttaacaaatgtgcctgtctattttaaaccaggtatactggtctgcaggtaaatttccaattaaaaagccaacttaattataagcagtttacagcacaaagggagattgttatatagtctggaattggccctggaaattttaatataaaaaataaaattagtagtagaagaataaaagacatttagtgatttccaaaaacttttagagacaattcttgctcaagatttacaaataaagaatacaatagaaaaatttgtattctaagatgatagaaaacaatatattctaacgttgcttaagagatataatcttacgtacttgctggatttgtttgtggttgcctttgccaaaggaaacttttttcaaaattaaagaattttttttttcctaaaccagcctctgcatttgcccctgaatgctggggaaaaaagggtgtgcaggaggggtgggcacaataaaaactgtgtgtgtgtgtggtgcattttctatacactcccggctatgtaggacggacagacccatttctacagtgttacctggattctctatgtagctacagacctactacattggggattacacaactctatgcctctaatattatgttgggctttgttggacacagcacaccaaggccagggtggacctggtggtgtgcacatatgctgtccgtgaagtctgaagtctaacatacttagaacattccttcttccagaatcacatggattcatgacctctcctaattcatctctatttaaatttcacttcatcacaaaagacttggtccgattatcacaccccacatcaccagcattctcctcatccctttccactgctctgttctccttatttggttagtacttactactatccaacatattttctgtccctcttcctagaatataaagttccattagaacataaactatttttcttcgctgctatatacccagtaactagatggtgcttggcacatggtgggtgctcacaaatttttatggaatgaatgtataattaaatgtttaaaataaaaatacaactgctgatcaatgacactgcagaaaggtccaccagagaatgcaacctgaagattggcagggaagtaattcatgaaatggctattgttctgaacacttagaaagtattaagatttcttctacctgcttctgacagactcagagtataaaaagtttcaaaagactgtgctgtggtgtggagaaattccaaatggaaaaattgaacatattctgtcatcagctcctttcagacagatgctctcaaggtgatcgatttggcagtcctggggagggatgatattacgtttcacatatacatcactggattaatcctcattgtggtattaaatctaattaacataaatctgtgcagtgacttatgttttaaatgatggggtaattatttaaatactttctactatgaagggagttgcgggcttgggttggagagacatagccaaaccagaaataggcaacaaaagactttccagaagaaaaatgtgacatagtccaataatatgagtgttacttaagaacacctaatacgctaaatactgatctgacaaagaagataaattgagaaatgatgattcatattcccaaagatttttttcatgttaatataagcatatttaatggagaaatccataacagattttaaagctttcattttctaaaagagtacgactcaaatttttataaacatatgtatgatatcaatagaggtaaatccatctcatttgagtgagtgcagctccagctttgtgtagatcttgagcatccttggtgagggtatgagaatgaagaacactccggagaccagaagcaacttatgactcaccaaagctctgactgccactcagtagcgttctaagccctccattcattcccattccacttcagtgccaagcatctgagatgggaaagtcatcttcagcccaccaacaagccctgagcggctgggcgtccatctccccatctgtaccagtggcacacatcactgttccattcatcatgtctatgaacttgatctgatttttgtcatgactgtcactataaaagtcactctgcatgagtgtcagaaggaaatttagaggtctgttgctgaggtaatatattttcagatcaaaatgtgggttattgaaatcattatatgtatattcacatgactacatattatcatgttaggagatgggactgatcatggagacatagtatctctctgcatcccatgagacatatctttcttacacaattcccactgctaggaagatcactgaactttccagaaagacgttcaccaaatacgctcttagtgggacccaactacacatcgtctgtggcagagacctacagttctcatgagtatctgagcagctctttttcctggaaacacagctgaacacttcccaggatcccttggattatgtgtgtctctgtgacaaagtccagccaatggaacatgcctagaatcaatgtgggctactccggggctgggcccataaacactacccagttactatcgtcatcctcttcctcttcactggctgagtagagaggattccaaggagctatagggagggggagccacaagacggaaggatgtggcttcctgaataatgggatggagatttaccatggctgcctgcccccaccacacacacaatggacagaaataagagagaaaagtaagcttttattgtattaatccattcaaattcagggcttgtttgttttatgattaacataccctgacaaataaaatgaactttaatggtttttcagaatctgttgcatttcattttctaaaagattacaatgcaaatttttataaacatatgtatggtatcaacagaggtaatccttatctcatttgagtgagtgcaaatgagatatgcatttttcttctgttgcatttacttttctaaaaaatattattttaattgtggtaaaatacacatatcataaaaattgccattttaatcacattaagtgaacaattcagtggcattgggtacattcacattttagtgtgtgttaccatcagccacctccaggatgtttttcactttggaatctgaagctctatacccatcaaacaataactcaccatttcctactccccaccccaactgctagcatccacctttctgcttcctgtctctatgatttgactactctatatacgttttccgagtggaattatatagtattttgccttctgtgactagcttatttcacttggcatgttgtccttcagaatcacccaagttgtaacatacgtcagaatgtccttcctttttatcacccacgttgtaacatacgtcagaatgtccttcctttttatcacccacgttgtagcatacgtcagaattcccttcctttttatcaccaatgttgtagcatatgtcagaatttccttcctttttaaggctcaataatgttccattttatgtatagaccacattttgcttatccattcatttgttgatggatgcttggtttacttctaccttttggttgttgtgaataaagctgctataaacatgggtgtacaaataactgtttgtgaccctattgtcaggctttttgagtgcaaatccagaagtaggattgctggattatgtggtaattccatttttaattttttgaggaatcatcactatacggtttttcacagcagcgacaccattttacattcccatccatagtgcacagccattccaatgtctctatatacttgctcactcttactttctgtttggatttcctaggatcttaacctccagaaaacataaacaaaagaagtgcatgatactgtatcacttactgtcatagattttaatgaatatatctgaaaattcgtttcaaactaagagctattcccaaatattcaacatctactgttctttgcttgataggagccacaaccactctctcctaaaaccaagctttttggttacaagtgatttctgtgtctgcaggtaaggttacagctggctttgtggttagtaaataatctcttggtaacagacttgcttcatctgtaggtgactgtatgaagtcaggccgagggctgagtcagacagctcagctgagctgctctggtggcgtgccatgagagtgtcacagccatatctggagcagattaacaagaaatgtaaattcccttccaaaaatagattccaagaagtagagaacttttaaaattactttctataggaatttccatgatgcctgaagctctaattaaaaagacttataaactctagctaggtaaagaatttttgaaaaactcttcctgcattctctatgtaagaataatacctagtgcttttttaaaataataataataagaagaagaataagaatattttgtgctgttattttcttgggcaaaaatttttagaaggctggaacaatcttgtaattttattctctagccttccaccattcctttacttataaaaaatagcattttaattaaaataatcctgaattccatgcaagattaaacacatgagaatagtcagcaatcttttggaacaaaaaaaaagaataaagagtgactttcactgtcagacacctaagtgtattatgaagcaacaatgatgaaaactaagtgataatcagcccatgggaataagtgcatagtccagaaaggaaaaaatgtccataaaatcattttggtatttaaagcaatggagcaattatgacctatttgatgaagacagtattatatgaacaagtggttaagccactagagaaagataaagttaggttcccattgtctcagaatttacatggaaattaattaaaatatgaaacaagtcttagtaaagatacagaacaataaaaacttccattccttactggtgagactgaaaataatacagctattctggaaaacagtatgccaacttattacgaagttaaacatacattgtgtctgtggtccagcaattctactcctgttatttgtccaagaaatatgaaagcatgttcccacaaaaagactgttataaaaatgctcacagtagctttatttataatagcccaaaatatgtaacaacatgggtgaaacaaaaaaacactgcattaggaagaaggccagacacaacaaagaatgcactatatgactacattcataggaagttttagaataggccaagttaacctatggtgatagaaatcagaagaggaatgtcctgaggcctgcagggtttatgggaagaatgaactagaacaggacatgagggccctttctcagggaagagaaatgttctacattttgattgtaatcatggttacatgaggcatgtattttccaaaacttgtcagtacaaactttataagtctcttatgtatctcaataaaaattaattgggaaaggtttaacatttaaaggaaaagactgacaaatataactacttcaaaatttaaatttctgtaggatcaaaaagactataaataaaagatgagtaataatgagaaaaaaatcattgactatgagacttagtttagtttaattaaatttaattaatttagagagaaatctcaaaattgaaaaaacatgaaaaactgatgaacatctgaaaggaaaaatgaacaaaagttataaataggcaatttgtgaaagaaatatataagccccaaacaaaatttaaacaaaattttaaatgtgtgatgggccaagggctaatatatctctaatgtaaaagggtttatagaaataggtagaaaatactgtatatttggatttttaaaaagcaggcaaaatataggaataaacaattcacaagaaaaaacacacactcaataagtgtcttaaagtgtctagactctctagaaatcaaggaaatacaaattaaaacaactacataccatgtctgaccctgcttctgctttttcctgcctctgtggttttctctttttttttttttttaatttgtttgtttttccttttcagaaccactgattctcaactcaatgcctgggaaacttttattaatgttcaagttatcaacttggacaccacttctcaggtagcttcccctgactctcaatgctaataggagccctgctttgcaatgctataccactcagtacgtcccctagcagagcacttatcacactgcacttactatccagttttcctacaatccccacaaaatcagttctgtaagggcaatgctacagtccaagtgcctaccaagcacagtacctggcacatataggtgcttaataaatattccttgaatgttttattgagtaatatagcattttcaaattgggaaaagctaaagaaaattatcgagtatcagcaagatttaagttgtggcactttcactcactactggtagaagcataaacagttataatgttttctgaagatgtagtagatggagttctccagagcaactgaaccaatcgcatatgtagagagaaataatttaccaaaaagaattggcacacatgattacgtccaagatctgcagctggccagctggagaccagggcagccgatgggataagttctactctgagtctgagtctaactcctaaagcaggagaagatcaatgtccttcctcaaagacaagcagggaaaaataattctttcttgctcagcctttgatactattaagggcttcagaaaattgcatgaggcccagccacgttggagagggcaatctgattgactccaacctgtgattctaatgttaatctcatccagaaactccctcacagacacatccagaaataatgtgtaaccaaatatccgggcaccctgtggcccagtcaagttgacatataaaatcaaccactgcagaaggtaatttgccaacatttaatagaactcataaaaatgcttaacttttttgacctggcagttcagtcttgaacaatgttttctaagaaaattatcagaaatatgtctctgaatacctgttaatggcatctctttgttcattggttgtaagataaaacaaccttaagagtgattgaataaattataaattacaataaaatataattcaaaacttaacgatgatatataatatagacttgcaattattgatataaaaacatattcacaatatgttaaatttaaaagtctatcaataaagacaattgtaatatgatctaattttaattttaaatatacaatatatacaatacaaaatatacaataaaacttccagaaacttaaaatgtagtgtgtcttctttgggtctgaaattatgcatgagtttttttaatttttcttttcattttatgatcctgatatttcctagttttaatttcaatttaattaattcaattaatcatgtaatttcaaacaaccaaaaaactaaccatgtgctttgaaagcttgacttacataggctacatctcaaaagtctgttccactcaggattaaaattaaagcaattagcttagttagatccttttcccttaagcgtttcatttgctgtctactaaaaataccgagctctgattgctttgctcaccagcctaaactattcctcctgatagagcctcagcaggacaagagacaagatgatgtttaggtagaggattgaaagtgatctgaaaaactgacaggtgtggtgtggtatatccatacaatgaaatattcagcctcaaaaaggagaaaatttttgacccatgctacaacatggaggacattaagctgagtgaaacaacccagactcatgaagacagacgctgtattatttcaggaacatgaagttcctagagtagttaaattcttagagaaagtagaatggtggtcagcaggggctggcggggagtggggaatggggagttacttaatgagtgcagggtttctgttttgcaaaataaaaagagttctggagatctgtcacacaacaatgtgaatgcacttagtgttactgaactgtacactgaaaaaagattaaaatggtaaattttatgttatgtatattttactgtaacttaaacaacaaagctgacatatctgactgggggaaaaatcagagtcacacagacttgacttgttgaaggatttagaactgatgagggctgacacagtggctcagtcttcctgccaaatccagggctcctccccttcatcccgccacctttcagaagctgagctctaggcacatcagagcaattaagacagatacttctatattctcaatctatcacccctggaatgaaagcaataatagtagctaacacatacagggtgctgactatttgccaggtagtattcagaaaacactttacatgcattgaccagataattctcacaactctgtgagggaagaattattatgaaatctcattttacagatgaggagcctgtgtctcagagaggttaagtaattttcccaagggcacgcagcctgcagtgggatagctacaatgcaaacgcacgcattatagccctagaatccatgtatataactgttgtaaccatgattcttatactttaaggaatcacctgaaagatttctcaaagctgtttcctggactccatcccaagagagtagttggtgttagggcccgtgaatgtgcctctttgacaagctcaccggtgctgccagtgctgctcggctgagagctgcatgctgagtggaacaaggattgcagcacactgtaagtgttgcaataaagcaccccagttatgttctggaattaaatctagtaaataatcaataatggatgagttacccgtggatcaaattaatttaccccaaatgacttgctattgatatgctcgtatttggtagcaatgtgagttgataatccaatttaaaagctgttacttattcaactctattgcagcaagtatgaggcaatgtgttctcatgacaagacggctgggaatctagagaaatgcaaaaccaaggaatatcatttagtgtaaaaccaccataacagcacaacacggtcttttaatcactacagcatcattttcagatgttacagaagttacagtatgactatagcattccacaaaatcctcacactccccttgctctcagtctatactctgcctttccagaagaggttgccttggatacaagtattgtcatgcctgtaaattttatcccctgtggcaagttagcaaattggcatccaggtttaataaatctgtctgttattaatgaataaatctagtctttctagcaagactcatacccacaatgcttgataacctctgagaaaatgggtaaaaccagttggtggactctcaaagtggacaattgcaccctacacccgtgtgacccaggggagcacagggaccccatgaactactcccccatgggaatgagtagtatccctctctcttgagactctgggactgcagttagtgaggttgggttctgaaaagatgctttcacatccccaattatgactaccactctagacttagaccagctgccctagggagaagaatgacagccccacatttaataatagatctcaggtttcaccttcctcactaggaacaatccgctcagcttagaagctctggagctgttttcccacaccgcaaggtcttctatcggtttgagagcccctggagatggcccacgctggtggcaacgaggcatagagagtcacacgagatcacttagctccccagtcaggtctactgcagtatgagaaacaggggagggaaatgttagctatttaaagatactagaaagaaaaacacatggcgtgaacatttttattaggtcataaggggtcaggcctaatagaagattatcactttattactggattccattttatattaccctgcctgaacaagactctcacgatagcaccaacagatttggctttaatgacttctccctcataatttctaatcacctacacttaaggaccattccccaccacaggaaagtgatggtggggaaatacttcactgcagtgaagacccttaaactcccaagattcagactcacctccctgagccccgagctcaccagtgagtccctcaagactgggtaatgaataacaccaagcattcatctatgaaggagttcctaaataggatgaagtagttaaaaatattttttaagaataattaaaaggcattatggaaaatcctgaaatatttcttttttttttttttttttttgagacagcgtctggctctgttgcccaggctggagtgcagtggcgcgatctcggctcactgcaagctctgcctcctgggttcatgccattctcctgcctcagcctctcaagtagctgggactacaggagcccgccaccgctcccggctaattttttttttttttttttttttttgtatttttagtagagacggggtttcactgtgttagccaggatggtctcaatctcctgacctcatgatccacccgcctcggcctcccaaagtgctgggattacaggcgtgagccaccacgcccggcctgaaatatttctaaacagataaaaaatagggtcaaatatgaactcattcttccttatatagaacatgtcctactagtcactaaggtgcccaggtttcttaattggtttgttctttgagctaatacctaaaagatgactaacatgggaaatgaaacccaatggccgcaacgtccttaaaacccatgcatccaaacatcctgtgcctctgggtagtctatggcaggctgaatgacagtcccccttggatatccctgtcttaatccctaggacttgtgactatgtcaccatacatggcaaaagggactttgcagatatgattaaggctacatatcttgagatgggaaaaaaatgacccttgattatctgagtggatccagtctaattgcatgagttcttaaaataggaaggggaatcaagggaagtgtatcacagagacagcagcatgaggattcagtgcaaatggctggttctgtgaggtaggaaccacatgcaaggatctgagaaaagttataggagctcagggcagccttcacttgacagccagcaagcaaatagggacctcagtcctacacccgtaggaactaaattttgccaacacctgaatgaacaaggtgatctttttctcctagaatctcaagaaaggaacacagcactgccaacatcttcatttcaggttagggaaatctgtactggatttaaagaattagaaaataataattttttgttgttttaacctactacatttttggtcatttgttatggcagcaacataaaactaatgcacagttttcatccaagttatacttctaattaaaaccttaccactttaacaaatcctgttctttctagccacagcctcttagcatgaactccagtttctttttgtaaagtaatcctctataaccttttatactaaactttctatactaaaagcatcagtagatttccttgctgtatttcagcccaaattagctgggcttgactaatcacagcagggtcatttaggagtgacataatcctaaacacaatcctgaaggtgaatgcatgctctcttttctgacattaaaggtggtttcaatcacgtctggcaccgactgaaaaaatgtattctggaatgcctcaggatgaaggaaagaaaaacatagatactgatcttccaacatcgcaatctggttctaatatcagttgtctacaggaagaattcactgttagagaatgatttcctcaagtctatttttaagatccctttaatgtagccatctgctaaattatcttgatacaaatgaggagaatttcagtgaacatctgaatttccttgtttataaaacgaaaactagatcacattccttatctagcctggtgataagaactaatttgatgtatacatatatcagtgtgtgtacgtaaatcatatacacagatttatactacatatacacacatgtgcaccaatcaggataagctagtttatgctgcatcattatctctgcctcaaacaaaccacccaaacttagtgcctgaaacagctcaggtttactccctcccagttctgtgtatcagctgtttggagtggatttggctagaggttcttctgttggtttcaccaggggtcactcatgtagccgcaccatggggtagcatggtccaagacaaatccattcacatgcctgcttgtgggtgctggcagtcagcagaagttgtgaagcctcagaaggcttttactcagaacagcctccatgccatttctcagtcccctttgatgtaagcaagtcacaaatccagcctaattccaaacgggtagagaaagaaaatctactccttgatgagaagagcaataagtcacattgcaaaaaggcacacacggtggtgggaagaatctgttgctatttcaataatccatcattacccccaaatatcaaagatttatttttattcccactgcatggccatcgtggttcactgggggctctgctgcccattactgctcattccaaaatgcaaagtgatggatgattctgccacgcagagcatgctgtgctggttatcagaaccaaggggaaaatgtcagagaagtggcctgcaggaaatgaaatacttccatccaggagtgacagttgtcactcccagccaactctaagtaagtcatatggccacatctaactccagcggagttggaggtgatttcttacaggtgcctgaaagaggagagctcaagtgagaataagtagatcaaacaggtagcacaacatacatgcatgctctcacacacacccatacgtgacatcaatctaatagtttgtcacaggcagctcaaacatttggaactacccaaaactctatccgtgttctggaaatgatagtctctgactataactcagttaagaaagaacaagaagattgatagtgtttttgtcatttccgtaagaaattttgttaagaatactctttcttatttgttccagagataatgatataaatagaattcacttgtcaatacccaattacttttgatcagacatggagggattctatctacaaactgaatcaaaaaatcaattgtcattttgaagtcagtacattatcatttctttgtaattcaaagctgtggtagttagggctgttctcaaatggtctttttctccttctggttgtactttcatccacttaaatgtgatcatgtgactttctttagtcaatacaattctacgttatatttgcatgctattctatactataaagcattattatatataaaaactcataaagttatcaggataataattggaaattagcttaatctcatgcaaactgcaaaaaaagatgattctacaaacaatatatgtgctaaaagaaaaaatgacaagataaataatactgaatcactacaatctccaactaaaattgtctgactcaactaaggcaataaatttttaaaaactgaaatcaaagtagaaatatattttaattgtattatatttcttaatgttttcttatatttaatgttagaatatttgcaagtctacaatggaggaggagagatttataaattccagctgcctataatagctcaactttttcagagacgtaaatttttttcttctaagaagaagtttttcacttcatgtagaagattatactaatatttacctgaacccaaattagggaaggtttatgtcgttgttgtttaacttaatatgctacccacgttaattagctatactgagcttgctttcttattttctcttagtatcccacatttataaagctatgtgctattctcaaaaagttttaggtagcagtccttgtaaggagttgaatgtgacactcagaaaaatctctagaactggtgaatgcaactttatttggatagaaagttttgcaaatgtaattaggttaaaaattttgagatgagattatcctgggttacccaggtaagccctacatccaacaaccagtgtcctgataagagacacagagaagaggggaaggctgtgcacagacagaggcagagactgaagcaatgcatctataagccaaggaatgccaacaattgcccacggctcccagaagctaggcagaggcatggaaaagatttccctcagagcctccaaaaggcaccaacactatcgacaccttgattttggacttctcatctccaggactgtgagataatacatttctgttattttaagtcatggaagtttgtggtggtttgttgtggcactcctaggaaactcagcagcccctatcgaaccatgcctccctcatcgccccaggctggctttcccttccacctcttctatattggcactccccaacaagcgagcagggccatcatctctgaattaacactatctagaattcatttcaccgtctagcctcctttgagttctgcagaaaagcagaggttgttatatcaaatacatcagatgtcaattgcaaatgtaaatttttaatcgtgtttcctttaggtgctgtgatgcatttgatgcagaaacagttgagctctactctaaatgcagagtacaagggacaggggagaaagaaaaatgagccatgcacagtccctccccttccaggcagctatatgaacatgtaagctataaaccacggtatatattccataacgatttccattttctttgctcctgttctgttttccaggactgaaagttgcctctagaagatgccacagtctgctgtcagttattttcttccacccattaaaatgcaaattggtatttctatgtaacatgtgacaggtttggataaaccgtgggattctctcctctcaattctttactgattgaattttaatctggattgcctatcaaaactcagcctattccttgaagttcagataaagtgtcacatccacaattaaaggtctcactgttacccccttacaatgcactttttatacctgagaaatgtgattacatttatttaacttactatgtttcgggcaccatgatttcatttaatcttcagggaacacacctaccattagatactctttacaaatgaggaaacaaacttggcagtgttcaggaacttgtctaaagtaattgtattagtgagctagagatgcataacaaagtcccataaacttaacagctgaaaacaccaatttattttctcatagttctgccagtcaggagtccaacacagaacagatggattctcttctcagcctcttacaaggtgtcagctgggccacattcttttctggaagatccacttccaggctcctccttgttgttggcagaattcaacagtggtagaactgaggtcccattctttgacacatgacctccatctgtgagcaagccatgacatatcaagccctgctcatgccttggttctctctggcttcctctctctgcttttaagggctcctgctcctgcgataacatcgaggccatctgaacaatccaggataatctcctcatctcgaaatcaactgattagtagccctaattacatctacaaagtctcttttccatgtacagtaacatttccctgggtttggcatcctatcatctcagttcccagtgattggggtgtggaatgttcttgggccacgattctgcttaccatagtcactcacaatcagtaagggacagaccagggatttaaacccaaatttgttttagtctttgtaccatgtcctgcttcctctctaggacacaccttaaactaaagctgcagatgttggtgagaagagagagtgtgatgtctaagaccacagcctctgggcagccctgcctgaaggcaaatcctcagccctctcatcagtagaatgagtataaaataatgtctgcctctagggttgttatgagaattcagcggcttaatactcgaaaagggcttgtttattactttgtctggcatatagttagcattgtagaagagatgttaaataaataaaagtaaaggaacataaggcaggagagtaaaagaacagcagtgtagaaggcattttgcccattttattataccatgataattcacaacgttttaaaaggtgaaatatttgtaattgtaacattaccctacttttgagctaatagtttaagatgtagccttgctaggtttcaacctatttttggacaaggagtatgacttatatgcattagatacttactaatcaatcagggagttgaactggattcaggaaagttatataacaagaacttcatgattctttttttttaatattgcctatttccaggcagattattagtggaaaaataattataaggagagatttttcaaaatatgtttaaaagcttttgtttttaaaatgaatttggagagagttctatttattgaagcagatgctctgactggaagcaaaatcaaaatctaattaagaaagagttacaacaatctccatgactgagagacccttgatgggcctagggcactagagctgacataacaatagatgctgggtctgatgtgtgatagggagggctctatgaagctcacatctgcccctaaaatgccacatcccctggccaaccacagctatgctcttaatgtctacaaaatatcttcattgatgttcattatatctgggaggaacaaggggcttcatcaatgaaagagcatccaggaatttatcagatggttgagaggaatgaaagcctgatttcttccttgatgatgatacttacagaaaacagattcaaatttgctagtaaaatcatagcagtgagtaagagtaggaaaaaaataggtggtgcatcttcctattgctgggtggggtgggggcaaaggaaacaaaaactagatctgcagataatagggaaatgaaagaaaagaaagaagaaaacagaaagcaagaaacaagaaggcaaaactaacaggtaacatcagttacaacaacaaatgtgagctgaattcaattacaaaacaaaagattcacagcatcataaaggaaattctattatatactatcccaagtgtatcccacctaaaataaaatgatatgtggtttaaaaataaagtgatgggtaaaatatattaggtacacgaaatcaaacacagaaaagtagagatagcgatattaactaaaaaatcaagctcaaggcaaattttttttaaaaaaagataaaaaaggtccttatatgagtataacaggcatgttccaaaataaaactacatgagacatgaaatattttttattgacttcttgagtccgtttttttctacaaattttaatacatgcataccatgtgcctggcattctgttgaaaactagaaacacatttaaactagacataattacagtcaggactttaaaagtttagatttcaacactcccacttctgcctcaacttgcagcttcctgttgtccaggaaaacaccctgatggcagggtgggcaactctacctacccccacctctcgtagccaggaaagctttacctgttagagcttccagcctagaggctctacctctgcctgaatttgccaaagggtacagcctcctgttgccctggaaatacctggattgcaggacgggcaactctatccaccttacttcttgtagccagatgggccacacctgctagagcttcctgcccagtggcctcacttttgtctgaattctgcaggcaggcataaccgtatgttccccttatccccacttggacagtagatttgggttgacctggaaaggatatagcctgtctgccagctttggcccctgcccgagggagacacatggagcagaacacccaacaaaagaaatgtgggcatgaagacagtaatcaaagagggctcctccaagacccaggagtgaactaaaattgaagccagtcaactgaacccactttatatcacaaagaaacccccaagagcatcaaagaaaataaaaacaaagaaactcacccaaaggataacaaattcaaatactgaaggaacatcagcccacacagatgagaaagaaccaatgcaagaattatggcagctcaaaaagtcagagtgttttcttacctccaaacaaccgcactagttccccagcaatggttcttaaccaggctgaaatgtcagaaatagaatttagaatatggataagaacaaagatcattgacatcccggagaaagttaaaacccaatgcaaggaatctaaggaatgcagtaacatgatgcaggagataaaaaacaaaatggccatattaagaaagaaccaaactgatctgatagagttgaaaaaatcacttcaagaatttcgtaatataacacaaatatcaacagcagaatctgccaagctgaggaaagaatctcagagctccaagagcagttgtctgaaataactcagataaaaataaataaaacaataaggaagaatgacaaaaactttgagaaatatgggactatgtagagaccaaacctaattctcactggcatccctgaaagaaagggagagaaagcaagcaattagaaaacatgtttgaaaatatccttaattaaaattttcccaaccttctagaaaagccaatattcaatcaagaaaatgcagagaacccctgcaagataccttacaagatggcaattcccaggacactaatcatcagatcctccaagatcaaaatgaaagaaaaaaatgttaaagacagccagagagaaggggcaggtcacctacaaagggaactccatcaggctcacagcagacctttcagcagaagccttacaagccagaagagattagaggcctacattcagcattcttaaaggagaataatttcaaccaagaattttatatctggccaaattaagattcataagaaaaggagaaataagatccttttcagatatggaaatgttatgggaatttgttaccactagacctgccttactagaggtccttaagcaagtgctaaatatggaaagcaaagaccattactagctagcacaaaagcacacttaagtacaaagaccatcagcactattaaaaaaaaaaccacacaatcaagtctgcataataaccagctaacaacatgatgacaggatcaaacttgcacatatcaatattaaccttgaatttaaatgggctaaacacctcaattaaaaggcagagtgacaagttgtataaagaagcaagacccaactatatgctgtctataagagacctgtctaacatataatgacactcataggctcaaaataaagggatagagaaacactggcaaagcaaatggaaaacagagaaaaagcaggagttgctattctaatttcagacaaagcagagtttaaatcagcaataatcaaaaaagacaaagaggggaatgacagaatggtaaagggttcaatccaaaagaagacctaactatcctataaatgtgcagccaacacaggagcacccagattcattaacgaagttcttagacaccgacaaagagactttgataaccatacgataatagtgggaaaattcaacatgccactgacagtattagacagatcatcaaggcagaaaactaacaaacgttttcaggacttgatctcaacatttgaccaaatggacctaagaaacatctacagaactctgtaccccaaaacaacagaatatatagtcttctcatctgcacattgcacatacctctaaaatcaaccacacaatggccataaactgtcctcagcaaattttaaacaaccaaaattataccaaacacactctcagaccacagcacaataaaaatagaaatcaatactaagaaaatcactgaaacccatacaattacatggaaattaaacaacctgcttctgaatgacttttgggtgaacaatgaaattaaagtagaaatcaagaaattctttgaaactaatgaaaacaaagatacagcacactagaatctctgggacacagctaaaacagtgttaagagggaagtttacagctgcaaaggcccacatcaaaaagttagaaagatctcagattaacaactaacatcacagctagagggaccagagaaacaagactgaaccacccccaaacctggttttgaaataaccaaaagcaaaactgaactgaaggaaattgagacacaaaaaaacatataaaagatcaaagaatctacaaattgattttttgaaagaataagtaagattgttagaccactagctagaataattttaaaagagagaagataaaaataaacacaatgagaaataaaaaggggctactactaccaaccccacagaaatacaaaaaaaccctcagagactactatgaacacctctatgcacacaaattagaaaaactagaggaaatagataaactcctgcaaacatataacctcccaaaattgaaccaggaagaaattaaatccctgaacagatcaataatgagttgtattaaatcaagtttagcctaaagatgcctccttacattttttaagtttggcctaaagggttctctgttcatagtgaatataacctaaatggaggtgtaaacagactgtaatttactcttgtgccaatcactgagttttgaccaatcaaagagggcaaatgttgaaactgtatttaaataagacaaatgctgagctgtttctgtatcttactactgttttctgtatatcattttccttgttctgtctataaatcttcttccaccatgtggctgcactggcatctctctgagcctactctggctcaggaggctgcccacttcatgaatcattctttgcttaaataaactctgttaaatttaatttggctaaggtttcttttttaacagttccaaaactgaagcagtaataaaaagcctgccaaccagaaaaagcttagaaccagatggattcacagccaaattctaccagatgtataacgaagagctggtatcatttctactgaaactattccaaaaaattaagaaggaaggactcctccctaactcattgtatgaagccagcatcatcctgaaaccaaaacctggcaaagatacaacaaaaaaagaaaactttaggtcaatagctttgataaacataggtgcaaaactcctcaacaaaatactagaaaaccaaatccagcagcacatcaaaaagctaatccaccatgatcaagtagactttattcctggggtgcaaggttggttcaacttatgtaaatcaataaatgtgattcaccacataaacagaactacaaacaaaaagcacatgattatctcaatagatgtagaaaaggcttttgataaaattcagcatcacttcatgttaaaatctctcaacaaagtaggcattgaaggaacatacttcaaaataataagagccatttatgacaaacccacagccaacattgtactgaatgggcaaaagctgggagcattccctttgaaaaccagaacaagacaaggatttcaactctcaccgctcctattcaacacagtactgaaaattctagccagaaaaatcaggcaagagaaataaagaaaagccatccaaataggaagagaggaagtcaaactatctctgttgacagacaatatgatttacacctagaaaatcccatagtccctgaccgaagcttctagatatgataaacaacttcagcaaagtttcaggatacaaaatcaatgtaaaaaatcagcagcatttccatacatcaacaatgtccaagctgagagccaaatcaagaatgtaatcccattcatgatagccacaaaaagaataaaatacctaagaatatagctaaccaggtatatgaaagatctctacaatgagaattacaaaacactgcttaaagaactcagagataaaaaaaacaaatggaaaaatatcccatgttcatggacaggaactatcaatatcactaaaatggccatattgcccgaagcaatttacagattcaatgctattcctatcaaactaccagcatcattcttcacaaaactagaaaaaaaactattttaaaattcatatggaaccaaaaaagagctccaatagccaaggcaatcctaagcaaaaaaaataataataaagctggaggcatcacattactcaacttcaaactatactaaaacacaacagtaaacaaaccagcatggtaccagtacaaaaacaggcacatagatcaatgggacagagcccagaaataatacctcacacctaccaccaagtgatctttgatgaagtcaacaaaaacaagcaataggggaaggactccctattcaataaatgatggtgggataactgattagccatatgtagaagattgatgccggaccccttccttacatcatatacaaaatttaactgatgataaatccaagagttaaatataaaacctaaaactgtaaaaacccttgaagataacctaggacatgccattctgaacataggccctgacaaaggtttcatgatgaagatgccaaaagcaattgcaacaaaaacaagaattgacaaatgggatctaattaagagcttccgcatacaaaacacacaatcaacagagtaaaagacaacctacagaacaggagaaaatatttgcaacctatgcatctgacaaagttctaatgtccagaatctatacggaactcaaacaaatttacaaccaaaaaacaaacgaccccatcaaaaagtgggcaaggacataaacagacattttcaagagaagacatacacacaatcaacaatcatctgaaaaaatgctcaatatcactaataattagacaaatgcaaatcaataccacaatgagatactgtctcacaccagtaaaaatggctactaataaaaagtaaaaaataacagatgctgccaatgttgcagagaaaagggaatgtttatatactgctggttgaaatgtaaattagttcagtcattgtgaaaagcagtgtggtgatttttcaaagaacttatctttgaaaagttcaaaagaagtatcatttgacctggcaatcccattattgggtatatacccaaaggaatagaaatcattctcccgtaaagacacatgcacatgtaagttcattgcagcactagtcacaatagcaaagatatggaatcaacccaaatgcccaccaatggcagactggataaagaaaaggtagtacatatacaccatggaatactacatagcatattaagaataagatcatgtcctttgcagcaacatggaggaagctagaggcattaccctaagcaaactaatgcaggaaaagaaaaccacatattgcatgttctcatttataagtgggagctaaacattcattacacatgaacacaaagaagggaacaatagacactgcggcctacttaagggtggatggtgggaggagggagaggatcaaaaaactacctagtgggtactactattcttattacctgggtgatgaaataatctgtacaccaagcccatgtgacatgcaatttaccttataacaaactgcacatttacccctgaagctaaaataaaagctaataaataaataaaatgtttaggcttaagggtacattaatatgatcataatttaaatatatgtgcagaagaaagccagtggaaggagatacaacaaagcctgtgtaggcattatggtttctttttcttatttatgcttttacttattttataattttctacactaataaatgttataaaatcatcacatatttgtatctaagtggcttctttaaaccctactcactattttttatttataaatactgaaattcaaacaaagtataaaaatcaaaataagtattttaagagatttttaaaattatatattttattttatttcttagccaataagagaagctgaaaaaaaaaacagaatttatccagaaaaaggggaatgaaaaagtttagcgttaccagaggtttgcttttccagttcagatccctctcttggggatcagcaatgaaggcaatagggcaaggaatttcacctgtgcacaaacgaaattcttcttgctgtcccttgtggcacttctccataccctgtctaatggaatggctctgaaacaactgaggctgctccccaggcccagcaaagctcatcccctaaatgagagcaggaagaaatagctgcagcccaatccctgcacccacccattggctcccacccaatgctccagcctctgcctaagccaggagatgctggaggctctgctgaaattttttcatgcgcttctgagaagaggtgatccttcacaaatcatgacatcagcaatatggtcctctcaaagtgtctggcatttggatgcctatcttctctagtttccaatgctgatacagagattgaacatagacatatatgtaacaaaactatggaatagacccaataactgtattttatatgccagctatgtcaggacctactggagagtcaggtcccctatgttcacttgccatttagtcttcaataaagcagtatatgatgatagtatattatgaaatatttcaaatacttaaaaagatatgcaggatattatgataaacaatagtatatcaaccacatggcttaagaaacaaataagtacatcccacatggtcctacacaccatataatccaaatacaatttatcttcccctggcataatgtttatataaaaattatatatggttagaacctggggccagatggtataggcttaagtgtaatctctaccacacaattaagtaatcttaaataagttaccttacctttccatgcttctgttcatcatccatattatgagctgataatagtgtatacctcacaaagatgtatgaatattatgtgggtttaatatatgtaattgtatttaattacatatacatgcattcagttacatatattaactagaattctacagtcctgaagatcatttcttaattatactactttcttaattagactactatctttctaacttctattccatttttcacataacccagaaattcactatttaaaaattaaattatgggaacaagggaagaacatctctctcctcacttctattcaagatcatactgggagttctagctggtgcaataatacaagaaaagaaaattaagggtatatgggctggaaaaggaaaaataaaactgtagctgacattcttgtgtatgtaaaaaattttaaagaatcagcaattaaaaaatcataatgctaataagtcgttatagcaagattgaggatacaaggttaatttacaaaaatttatatacatatgaacaattgaaatttgatattaaaaataaaagcccacttataataacaccccaaaatgaaatcatatatatatatatatatctaatatatatatgtaatttatgtacagaaaactctgatgaaataaatcaaagaagatcaaaataagtggagagatagtctatgttcacagattggaagaatcaatgttaatatgctaatatattccaacttgatccatagagtcatcctaatcccaatcaaaatcccagcaggctattttgtagatatcaacaaacttattctacaatatatatgtatagaaacacaattcattcttgtatgtttattagtaccctgcaactttactgaatccattaattatttttttctttttcttttttttttttttttgagatggagtcttgctttgttgccagactggagtgcagtggcgtaatcttggctcactgcaacctccacctcctgggttcaagtgattctcctgcctcagcctcctgagtagctgggaccacaggtgtgcaccaccacacccagctaatttttgtatttttagcagagatgaggtttcaccatgttggccaggatggtctcaatctcttgacctcgtgatccacccacctagatctcccaaagtgctgggattacaggcatgagccaccatgccctgccccatttattatttctaacaggtttttcttgtgtgtgtgtgtacagactctgagattttccacatataagatcacgccatctgcaaacagaaatcattttacttcttccttctagaggtgtatgacttttattacattttcttgtctaattgctctggctaggaattccagtgttatgttgaattaagtggtacgagtgggaatccttgtcttgcttatgatcttagaagaaaagcttctagtttttcaccattgaatatgatattagctatgggattttaaatatagcctttactatgttgagataaattccttttattcctagcttgttgagagatttaattctaaaagggtgttaaaattttgtcaattttttgcatctatgaagattttcatgtgatttttaccttttattttattaatgtgccatatcacattaattgatttgcatacattgaaccatctttaaattccaaggataaatcccacttggtcatgagtatgatacttttgatgagctgttgaattcagtttgctggtattttgttgaggaaaagaaaactatatatggaaatgccaaagacagaatatccaatacaatgctgaagaagaacaaagctggagaactgactgacttcaaaacttactaaaaaactgcagcaatcaagatagagtgggatgagtgaaagaacacacacagatgaattgaatataacagaaggcccagaaatagacctacacaaaatattcaattgagtttaactatggagcaaatttaattcaacgaagaaaggattgtcttttcaacaaatagtgctggaaaaattgggtatacatacatacatacacaaaaatatagacatagaccttataacttttactaaaactcatgcaaaatagattataaatccaaatataaaatgcaatactacaaaacttctagaagaaaacataggagaaaaatctatgaaaccttggatttggaaataagattttagatacaataccaaaatgtaatccataagagaaaaatttgataaattagactttattaaaatttaaaatattggcttatgaaaaaaacagttttggtgggagtataaattagttcagccattatggaagacagtgtggctattcctcaaagactaaaacaagaaataccattcaacccagcaatcacattactgggtttttacccaaagaaatataaattattctaccataaagacacatgcacatgtatgttcaatgcagcactattcataatagcaatcacatggaatcaacctaaatgcctatcagtgatagactggataaagaaaatgtagtagatacacacaatggaatactatgcagccataaaaaagaatgagatcatgtactttgtgggaacacggatggagctggaaaccattatcgttagcaaactaactcagggacagaaaaccaaatactgcatgttctcatttgtatgtgggagctaaatgatgagaacacatggacacatagaccggaacaacacacaataacacctattggagggtgaagggtgggaggagggagaggatcaggaaaaacaactaaggggtactggcttaatacctgggtgatgaaataatctgtacaacaaatccccatgacacaagttcacctatgtaacaacaaacctgtacttgtacccttgaacttaaaataaagttacaaaaaagagaaccaaaagacaagacagaattaaaaaaaaaaaatttgcaggcctcatatcttaaaaagcatctgtatttcaaatgtacaaaaaactgaaccgatacctcaccaaagaagattagacaaaccaaaggcaaacaagcatgtgaaaagataatcagcatcatacatgattatgaaaatccaaattaaaacattatgttactactacacacctattagagtggcaagaatccaaaacattgacaacactaaatgctggcaagaatgcaaagtgaaaggaactctcattgatagctagtaggaatagaaaatggtacagccactttagaagacagttcgacagttcctcacaaagctaaatgtagtctcatcatatgatccagtgatgctcgcaggtattcacccaattgattagaaaacttatgtccatacaagagcacacatgtgaatgtttcatagcaaccttattcataatcactaaaaaatggaaacaactagttaggcatggtggctcatgcctataatcccaactaaatgggcagctgaggtgggaagattgcttgagcccaggagttcaaagctgcagtgcaaaatttttggaatctatccatctgacaaaagtctaatatacagaatttacaaggaacttaaacatatttacaaaaagacaaacaaccccattaaaaaaatgggcaaaggacatgaacagacatttctcaaaagaagacattaatgcagctaacaaacatatgaaaaaaacctcaacatcactgatcattagagaatgcaaatcaaaaccacagtgagatactatctcatgccaatcagaatggtggtgattaaaaagtcaagaaacaacagatgctggtgagtttgcagagaaaagggaatccttttatactgttggtgggaatgtaaattagttcaacagttgtagaagacagtgtggtgattcctcaaagacctagaaggagaaataccatttgacccagcaatcctattactgggtatatacccaaaggaatatagatcattctatcataaatatacatgcatgcatatgttcattgcagcactattcacagtagcaaagacatggaatcaacccaaatgcccatcaatgacagactggataaagaaaatgtggtacatacacaccatggaatattatgcaatcataaaaagcaatgagattatgtcctttgcagggacacagatggacctggaagctgttatcctcagcaaactaacacaggaacagaaaatcaaacaccgcatgttctcacttacaaacgggagctgaccgatgagaacatatggacacatggtggggaacaacacacactggagcctgttggggggtttgggggagggagaggatcaggaataatagccaatggatgctgggcttaataccaaggtgatgggttgatgtgtgcagcgaatcaccatggcacatgtttacctatgtaacaaacttgtatatcctgcacatgtaccctggaacttaaaataaaagttgatggaaaaaaatggtgtcttttaataggtgagtggataaaataaactgcactgcacccagaaaatcaaatcttattcagcaataaaaataaatgaactatcaagccacacaaacatggagtgaccttaaatgcctattactaagtgaaatgagccaaactgcaaatgctacatcgtgtatgattccaaatacacgacattctataaaagacaaaagtataaggatggtaaaattatcagtgattgtcaggggacagggggaaaggaaggataatgggcgaagcacaggggatttttaggacagtaaaactattctaaataataccgtgatggcaaatacatgacattacgcatttctaaagcccgtagaattttatagcgcaaagaacgaaccttagtgaatatgaatttaaaagatcattttgaggttgggggatcccaggaagaaatttaaaccatgaccagagaatctaactgtactatgaatgtattaaccacatgggtaaaagtgagaagaaaagtttccgacttaagtgactttggaaatgagtaaagtctatgaaacaaaaggcaacaggaactgcccataaacactgtactctagttgataaagttatatcccaaaaataagggctaccaatgctgatactacttacatgtacactggaattgaacaattaaatgaatgtcagatggtggaatccaggtttctcactgtggaagtgagaatttatagacaaacaaggaggaggctagaatgatatatgtggaaaggaattagagttagagacatcagtgtgaactcatgtttagcttaatatggaaataaatggtaacatacataaatatttatagatacatgtatatatgaaggttagcatatgtccctatattcccttgctgtgtcagctgtgcaggtctaatgaaacaacatcccagtagcaatgaggacatgtagcacccagatcttaggttctaatatcattctccagtggaagaagccagggctccctggagaaatggctaattctagtactggggcaggaaatatacatgataagcctagagtatcttatagagtcagatagtaaggaagtgtttaaaggaaaaccccatattaatgggagtgtgtcaaaggcacccaggagccactgaaaaaagttcccaatgaccaaaagttgttaaagattgtgtacaccaaaagagttcttaatgaccaatttgaaaaacaaaataataaaatattactggactataacccaaagcatataataaatattcatgaggccgaagaggtgtaaataagtgattagtaattacatacatttataaatggggagaagagacagtcttacgggtggaagagttcctaataatttatgtagatattctttcctcaagaagggggagcataagttctactcccgaaagtgtgagttgtgcatagcaactatcttccaaaaactgcagtgtcgaaaggaagaaaaaaagaataactgtatagaggagaaacctgaaaaacactacctcaaacaggtgatcaagttcaacatcaacagccacaaatcatgttgataatatgtgcctttgataaaatgagattaaaaaatggcactttacttctgtggtcactcttcaaataatccatagccctactctcatcatgaaaaaaatcatcaaaaaattcccaataaaggggtatcctaaaaaacacctgaccagtattctccaaaactgccaaggtcatcagagacaacaaaaggatcagaaactgccacagtcaagagtaaactgagacatgccaattaaatctaacgtggtatcatggctgggcatggtggctcacgcctgtaatcttagcactttgggaggccaaggtgggcggatcacttgaggtcagaagttcaaaaccatcctggccaacatggaaaaaccctgtctctactaaaaataaaaaaaaataaaaaaattagccaggtatggtggcaggggcctgtaatcccaactgctcggaggcagaggcaggagaatcactagaacccaggaggcgggggctgcaatgagctgagatcgtgccactgcactccagcctgggtgacagagagagactccatctcaatcaatcaatcaatattttaaaaataaataataaaataataaaaataaatctaacatggtatcctgaatggactcttggaccagaaaaaggacactaggtataaatgaagcaaatctgagtaaagtatgcatttcaatataatagtgcattggattggttcattaattgtaacaaatgtactctattaatgtaagatgataaaaatagggaaaaatgggtgtggggcatatggggaccctctgtaatatcgtctaaatgattctttaaatctaaaaacatcctaaaaaattaaggtctattaaaaatttaagttagataatgaaaatttcctttaagccctttaatgtttcctattacttgccaggtaaaattgaaacttcatccttagtactgagtaccatctcttatctttctcccctttccaactcacacctgttcaacatttcaggggacttctcatgtttctgcaaaaaaaaaaaaaaaaaaagatgccctcccacaattacctgctttagagatatttcttctgcatgacattccattatcctagatctctctcagaaaatggcttatctttgaagattcagcttacttgctccctccttagacaagtcttctgtcaccctactataatggattgattgggaacctcttctctgtgcaatttggcaactagagattacaatttagtcctgcttctcagtgtggtccaggagccaacagcaataggcattaccagggagcttgttagaaatgccgaatctcaactcatcccaaaccaaaagaaacaaaagtggcattttaacaagatctccagattatttatagccatattacagtttaaaatgctttgagtatctagaatttagctctccttaagcccttagcacatggttctctggttgttttaattgcctgtgtccttgccaagttatgaaatcacctgaggacaagggttatgtctcattttttttctttatcttcaatatgatcacagtatctggaacattcaggataaccaaaatgaattaatgactagctgaaggacacattaaatgagagtatgtattacaaagctttacagtttttataggttaatacctaacactatttttccttgccaaaatttgtgaacaactgagagacagtcaagggtcagaaagatgatgtacaaaacatcaaatttattgccaacaaagcaggtttggcagaacatggctttgttgtgtagctaagcagctttttaatactttgcccagaattaggcagacaaaaagcttacctggggtttccctttgggggtggggatctgctcttggaaaacctaaggcatggaggagcagccctgccttgtgctttctgcaggcagaatccaaagaaagtagaaagagaagtgcctttcaccctgctcagcttcatctgccaaactcacagtcagcccgtcacccttccttctgtgtgaccctgatgaagaaataaatactccctgcacccagtgggaaattcagaggaaaaaaggagtgaggaggaacaaaaggataaaagagaaatacaacacaagaactatgatcatgatgattttaacatttcacagggcagatcatgcacctgacactgagaaagaatactgaaaggtgcttgatttttagcatgaggccctccaacctgccacactgtcaatcaaactagaactgcacatgtggattctgagggtttaaaatgcctcattcagcctacaaccccaatgaggacacccaaactaaagggtgtggttacaatcacagtgttttatttaccgctgccagtggcctcattgttttccaacaacttcttcctctattgactagaaaattacataatatgaaatgtaatgacatccttaacctgttcagtaagtatcaactctaagcaaccaacagtgatcagctaaattctgagggagccagggacgtaaaaagatcctttaatgtagtctaatacaaaatacaagggctcagagtattgttatttaaagtattatttattctttgccttttatataccattgaatactacaaaacttgtttttttcctgcaaacctttgggtaatttacattatagtataatatgtatcctaataatttaatattaatattatgtattataattgcttaataatctcatatgtattataatcttcaatcaggcagaatgccatattctataagttcccaagtctttttgaaatgccatttaacaaatgtgatttaaggtccatgtgtgtattaccctaagtgattaagatgatgatactcactagtcatacacatttcaaaaatacacacagtcaagtttatcaactaccataattttgaaagttttgattgctgatagtattgtcaaggaggaacagagtcctcgaggccagtggctttacccgtaagcctgcaacacatcctaatgctcaagcagacatgcaaggcttgtttcccctggtcctttggaaaaagatctatgttagcaacagaggatgggaaacacttagcatgcatggccatacacctctagctagtgcccttggcaggcattactaattgatcacagcagacttctcccttgacctggatgttgctttctcgagtcagagctcagggcagccactattaattgattggagtttgcatgtgaaataaaaactatctgatatcccatgggcttctatgagctggaaactttctctttctccttcccccaaccccaacccaaaacatagctgtgtgtagatgcctcagcctctgatttggttgtgtgtgatctttttccaatgtcagctcaaggttttgattctttactgtcaggttgccagcatctacggaagtgtgtggcatatatttgttacaagaatgaaggaagaggtaaaggtaggtgatgaaaattaatgcagggattataggagaagaccaggtctgggcaaagtggaggtttgagcaatcccactactggcattcatttccaaaggccatgaaatctgtatatctaaagggtatctgcactctcatgtttattgcagcactattcacaatagccaaaatatggaatcaacctaagtgctcatcaatggatgaatggataaagaacatgtggcatatgtatacaatggaatactattcagccataaaagaaaataaaatgttgtcatttacagcaacatgaatgagcctagaggatattgtgttaagtgagtaagtcaagcacagaaagagaaatacctcacgttcttgctcatatgtgggagctgaaaagttgaactcatagaagtagagtagaattgtggttattagaggctggaaatggtagcagggagaaaaggcgaggtagatgttggttaacagatacaaaattacagctacataggaggaatgaattcagtagttttgctgcactgaagggtggatacacaatagcttactgtatattttctcctttttgagatgggtcttactctgttgctaaggccgaagtgcaacagctattcacaagtgtgatcatagctcactatagctgcaaactcccgggcttaagtgttcctcctgtctcagcctcctgggtagctgggactcagcacgccaccacacccagctagtatatttcaaaaagttagaagacaggattttgaatatttcccacataaatgataaatatttgaaatgatagatataattaccctaatttgatcattacacatagtatacatgtatcaaaatctcactctgttgcataaatatgtacaatgattatgtatcaactaaaagttaaaggaaaaaaaagacaagctttgaaatcaaataatacaacaataacaaagttcaggtttggactgactgagcctaaagtatctgtgaggcatcttcctcccctgacaccctctgctaccacacagaccccgggagcacaggaggtatgcatggttcagaacagggcctggaagctcacacaggtccagtcagtatttgttgatggaggctgaattcataagcccatggactgtatgtatctggagagcagaagggtctggattagcagcagagatctgagaggcattcaagggaaagtcaaagggagagctctgggtgaatagaaaataaccagataggattcatcctttattgatgaaagtgctggatgacagttttatcatttcaacaacccaagctgagactttaagaaaaatatgaacttttgctctttgaaatggattaattggccatacaatataaccttgcaaaaacacagaaaataccccatcgagactaaaacatgtcaaggaaaaagacttttggagagctatagatgtaataatataattacaaatacttataataacaattatatactacatatttattacatttgttataatatcacatattatgttatattgtaaatatatttatagaaataaaactgggcaaaatgtctttggaaaatcaagtgcactagaaccacagcccaccatgagtactcaaaaatttaaaaactgtgtctaagtttaggcaggctgaggaggttgttaaggattcacaacagatctcaaaactttggatggcttctgtgcaaacacccatccaggtctgatggctgctgatacaatgacatgctccagtgtatggcacactatatagtgtccagggaagactgcaaagtatttctatacctatttttttaagtacagtgcattgtactacatacagaattaaatattgttaaattatgcaggaaaatcctttaggtacataatgccatttgattgtatcttttcgtttgtttgtttttgtttttgagatggagcttcgctcttgtcacccaagctgaagtgcaatggtgcaatcttggcccactgcaacctccacctcctgggttcaggcaattttcctgcctcagcctcccaagtggctgggactacaggcatgcaccattatgcccaggtaattttatatttttagtagagacagggtttcgccatgttgaccaggctgatctcgaactcctgacctcaggagatctgcctgcctcagcctcccaaaatgctgggattacaggcgtgtgccaccgcgcctgaccttgattgcatcttttaagctgcgatcggatgaccctgttacacaagatcttcatttattattaatcttacatctatttcctagcacctatataacataactgtcctgaatgccagcatgtcaccaacaagacaaagctcttgccattgggaaaatacaacctaaacaaaattattatcactgaggaagaaagaaaatattggtctagcaataagaatgttatccctcggcatttctcagggagttagtcaccagatgggaaatccagcccatggcgaactccttcttagtggtcattcaccccaagaatttccctgggactttgctctgtcatgtaattaatcacacactaggcctgcaatctgatgttcactttagctttatttacaagagtaagatcaaaggaaaaacaacaaaaaaagagagagacaaagatggggggaagggaggagaggaagtgggcagaaagaaggaaacagaaagaaagaaaacagaaagaaaagatgtcactataaagggccaacatctggggaaatgggcagacaaactatattacgttcacatgacagaaactatatggctgccaaaattttcttttcaaaaaacttaatatagggaaatccttctactaaatgttaaatttttaaaagcaaaatttaaagccatatctatcagataattgcaattttatttgaaaatatttatcatacagaaaatgactatagaagtgaaaatagtaattataacttggtaactgtacttgtggattattttattttcttctatgtgtcttcctgtatttatttattcatttttttgagatggagttttgcttttgttgcccaggctggagtgcaatggcacaatctcggctcactgcaacctccgcctcctgggttcaagcgattctcctgcctcagcctcccaagtagctgggactacaggcatgcgccaccatgcctggctaattttgtattttttagtacaaaattagacagagtttctccatgttggtcagcatagtctcgaactcccgacctcaggtgattgctcgcctcagcctcccaaagtgctgggattacaggcgtgagctaccgcgcccagctgtcttcctgtatttattatcctgtagtgctctccaaacaagcatgctttattttaaaaagtaaaataacaaatgctacatttaaaaaatacatctgattatcttttgtggtttttaaatacatgtaaagtactcaaccaagattaaaaagtgtgaggtgttggggctcagaaaccaatacaccaaaatatggggttttgacacatgctgaactgaagcaggcccctctgaccattcgccccacccccactgtctctcccaaattgtaggataaagttgttctctgaagtttccctttctgcctgtagtccagatcccccgaagaagaaaacaatgtcctccggttggtcccttccctgagttttcactaaccgtactcccgtcagaggaaagaagattaaagtctgtcaacaaacctggacagacttttgtcacaaaccattttctgctccgcgggcccaagaggctttgttcaaagccactgtatgttctgtgagcctgtggaatcctcccttgtcatcactgattacccctcagctgaaatcttcatttccctttcccataacctgttttgccaggatccaagcctccattctttctgtaacctcaagacattgtataagcttctgcaccccatgagggggtgagtcttcattctgaaggctctgtgtatacacattaaataaatgtgcctgccttttctccaattaacctgcttttgcaagttgatatttcagcaaacttacagaggaccaaggggaatccttggactttacaggtatttccttgatggacagcaaaaagataacttgagttattaatatataattcaaacatatgtcctaacgcatatgacatattctaattaggaatcactaacatatactttgtaaataggaaccatagaacccatgcgatttgacatagtgtgtctatttagagtctagtatatttcatcatctcagaatcgagcatgttaagacagaataacagtaatatcaccaaaaatgagttttagaaatataaatatcctcagcgctccccccctcaatattttattggtggtcttgttatttatagtgaactactatcatgtaacaaaagccaccaatgaaaaaggaatacatggatgttgttatcttctcaggaaaggttttcaggtaaggctggtgtctacactgcagttttatttcatgacctcctcatccctgtctgggtgagacagccccataggagctggtagacttgatggattatcgaggctgaatagaagggccggataatgcagctctgtgtgcttggtcaaagactccaggatcacagcttagaccctctttttctgctctctttttgtcatcctatctcccgtggcctccaaagtgtccccagcacctctagcttattccccagggacctccacgggccatgcacagaacagggcagaaatgctggtctgatgatggtgtgtttcccagtgccattccagagctgccagctttatctcgcaccctctctaaagcttcccccaatcccagaagcccacacacatgctttgtaaaagcgactgtctgcagctaggcacaccagggcgggaatggagcagtgggaacccctcctgtgttcacagctttctgcttggggactggctgctttggtattggccagaaattgcctagtcagagccaggccctgggaagaagtgctaggcagagacggccccgaccatcacggcatcagcaccattttcatctgctaatacaaggcatttaaaggctccagagaactcacctgcttcaagaagcttttccaggatcactctcaatggaggacctcgattcttgcccatttactgacttttatcaactctatggctctactctgacctggctagctcactcactccatctatcttcctagctacctacctatcatctatctacctatcatttatccaccctgtgacctttaacatttctgcttatgtttccaaatttatcactattgtaaaactatccagtggactcccaaaactatgaggcagtccttctcgaagggtggtccccggaccagcagtgtcagaattacctgggaacatgtcagaaatgcaaatgtccaggttccgccccagacctactaaattagaaaccctgagagggtttaaaaataagccacccaggtgatgctgattcgtgctcgggattcagagctatggccgcagggatttaacacccaccagtatccatttaaatatatatatataatcataagctcttttttaacagttggaaaattcatatcattatttttgctccttggactcttcttccacagatttttatcacaatgtaatacatttttcaggcttgagagtcttttgtttgttactctatcacacttctctggaataaagttgtatacagaaatattatcacttaaaaaaaatttctgtctataagatactaaatattaaacgttttttctagctgttatatattataatttatgaaacatcaaaattttcataaatcttattcaaataaaatattacaaattcatctcctaataagatgagtgagaatctctttattctcagtagttcacatatcctcggatgaagtaatcatcttgcttactgcacgaatgagctgggagtcagcatcatttctattcttatttaacactaaatgttgaaaaactgtgtttgcataaataagttgatgagaacagaagttttgttaaaatagttctttcccaattaattgaatcttttctaaactatacaaccaaaactgtatagtaatctagcattggaaattatttttaaaacctaaaaacgtgactagaatcctcttcaactttgttgaaagagaagaactagagcctgcttatgtggtaacagaatgttaccccgctattaaaagcgttcttgtaatttttgtaatttctggaatatatatgccccccaaatattgaccaagacttatcaaatgactttcctgaagatgtacctttcttaatatacacatttgggaaaatcaaatgttgtgatttgtattattgtgtagtgatttttaactagaatatccatgtctatgatgatggctgcactgtaaagcttctacttaagggaatggcattggcacagcccctaatacaggtcatggtccctggatatgtgcaatgtggtggccctaacatgcttttgccttatcagttacttaaaatatattttcattaaaattaagcacgcaactcagtttatggaaaataaccttcgtgttgtctaattagccaaatgaggaatcgttgtcagcccaatcaagtcagccttaatttctgtcagagggggggaaaaaagtgtgacttaattttgagttaaaagtgttgatacgtaccccttgaccaaccctcttgcttctgaatttgtaactggacacagacataaacaagcagaagatgcttgctgtgcattgccaaccacacgaaataaggggcaacagttttcatgctaaaaccttagcctcagttgtcctggggctcatcctcctgagcaaggcatcctttaccaacaatcaggacgtagaagagaggtcattaaaaacaaaacagagcaaagcaccctttccactacccactctgacatagatctgaacacagtccattcaaaaacaggacaaagcccttctttctaccaggcctcactcgacaaagtgtgcgtagcccggggagataaacgtgggcgtctctgcactgtcatgggttggatgatggtccccagaaagatatgtccaccgcctaatatgcaaagcctatgaatgtgagtttacttgcagatgtaattaagttaaagatctcaagatgaaatcatcctggattatgctgggggcccctcaatccggtcacatgtgtcctcataagagacattcagagggagacagatagacagggagcagaacacaaggccctgtgaagacagaggcaaagactgaagtgatgcagccttgggccaaggaatgcctggagcccccagaagccggaagaggcaaggatcccccatagaacctccacagggagtgtgaccccgctggcaccttcatttcggacttctggcctccagaactgtgagagtataagtttctgttgttctaagccaccaggcttgtggtactttgccttggcagccacaggacgcagacacaggcattcaggctgaaggaggcttgccaaagccagtcttcctcactgcatagcatctgctgcttctcagcttcttggaagatgccagatgagcatgcccttatttcatatcgtaaggaaaggtgattataaaaaggggattgagaaagcaaaactggcatgaagactgaagaagtgaagcaaaagcatcttctaaaatggccaggctggggctggccaggtggggcctgtgttccagttaaggacaggcggaacccttacatgcatgttacttggtaaaacaaactgagatgtttgatgctttctttgagatctgagtttctggttctataaataggaacttacatgaatttagacttaaaaagaaaaagtcccctagagtccttgtcccttaataatgaagcagagaatcaggtctgggcagatcagatcataatttccagaaggataaaacagggatgacatattctccaccccagacccctttgcactttgggttcaaattagtcatctcttctccagggtttggagtccatggagttccattctcagctgtcctctcatccccatgaagaggagccatgggcttggccttgtctctgggcttgtgtcctcatcgggctccgcagtctgcatctcatgctcactccagctccagtgatgatcaaagtttgtgtttctcccttggttcgtgtgaaaggacatctgcactctacgtgcttgtcagagcgcatctgcagctcagcaccaagccaggatcaccggctagtagttcagaggccaactatatacataggactgcctgagggatacagtgcacccttgctccagattggtacttctgaaaatggaaggccacacactttcagagcctggtgaaggaatggactttcaaccatgtgctacacaatcatatttttgtgttcaattttatggaggtacacagacgctcccccaacaaagtccattcctatgaatcccagtggttgtagatatcctcaaagttatccagaccatcaaaaagctgtacacctggtcagaaaatttatttccctgttaagatgttcatcccaaactgcactttagtctcctgccatctgcttccagtaaggactcctgaacaaaagtgctctgcccttcctcacttgctttgcagtagaactactgtgaatgatgttcatcctaatatagggcattgtcttcatgacataatgagaagaccttctcccagatctgcaggcctaaaagagccaggcctccttggataagcatttatgttggcagagtccatgactcagcatgatatcctttatgtgatgcggagctggatttgctgatctcctctttgtagataagcctcgtcctggccatatcttttttttccctcaaccctgatttcctcacttatttctttaaaaatttattcaccaaggaagatgacaatatctggggcacatgctgaaggcggctcatttggtttatctctctctatggagttttcctctctcttttcctcctgctcctctcctctcccatcagacacttccacccagccatttccaaaagaagagctttcaagggctactcctcatcactgcatgaacctctctgggcatgagcaaaacactccacagagattgacaggtgcagctgagatggctttctgccttcatcccccaaagtgaaaaacaaataggtattaatataaattctgatgaatatatagattgtacaatgcttattttaaaaatttggtctcttggccaggcgcggtgtctcatgcctgtaatcccaacactttgggaggccaaggtgggtggatcacttgaaatctggagttcaggaccagcctgaccaacatggtgaactaaaaatacaaaatttttagttctctactaaaaatacaaaattagccagacatggcggcacatgcctgtaatcccagctactcgggaagctgagggaggagaatcgcttgaacctgggaggaggtggttgcagtgagccaagaccacaccattacactccagcctgggcaataagagcaaaactccatctcaaaaaaaaaaaaaaaaaaaaaaaagagagagaaaaagaaagaaagaaaaataaatttggtctcttgcagacatttgcaaaagcttcctcaagtctgtttttttttttaaataaagaggcataataataataaacagacaaatacatttcttaaatttctattatctgtatcccttgtccagtaataataccatgatctctgtcttgatgctttctgtccccagagtaagactgccgactacgttgccttttaaaaaaataggtatatcacacagctgcagttaactgacgcttggtcagttagactggtttttatacagtgttggttgttacatagcagtttaaataatatggccagttgttatgctcaacaacaatttagaatgcaatacatttcaatagaattaaactggctattataacgcaataaccctcacctccaggtgtatcttcaaagaaattacaaaagtaaattgagaagaacgagctttttagtttttcccctgagagatatccaattttaacaaagctattactggtctagtgttatcacatggaaaactgattcttagtaattcacaaacgaaggtttgtaactaattaggtcccctttgccaaaattaagacacaaaccaattacaaaattgacacttttaagtgtagcatcaaaaatgtttgcagctgttggcaataagaaagcagacgacaaattgtaacaatgaaaaaaaacaaaatcaaacacattttaatgcatgaaaatgtggaggaagttaataagagatcaaagggaaatgattttccgtagttacaaatcaaacaagacataaaccaaaaatgacttattgtctttagcttaggagccaccaaatcagagccctgaaaaacatgtttttgtacacaaaaaagtaaaagaataagaaaatgggattttgttaccctacttacaaaacaaagattttcttaatttgggcttcaatcattttaataggtgccattttgtgtttgaagtatatttcctcctttcgtggcccatcaatctgtgagagaaaaatgtcaaaggaccattttctttctaatgagtttctatgtctgttcttaattgtagatctttcatgttaccttattttaaatctaccgtaactcatgatatattttgccaataacttatgtcagttataacataaacattgaggagtttggtatgaaaaaattaataactgttgaaacaattcctctcaatttctttttatcaaattgcttagttcaattttgatcattaatatcccatgggggtcattgcacagagttgcctctttctgtagaattcaccagtgttttaatttttatcattttatttcactattaaaggatttttctcaaatccatgatatcattcagtgttttattcttgagctctaggagtaggttaaacgatatgtaaaatcctttctccttccagttcatggtgctgattctagcattaaccacctgggtcaaatcccaagggcactgtttacctgctgtgggacttagggcggttacgcaccagtacatgacttctatctaaaaaggaaggaagaatgttactgatctcacagagcagattaaaacaattcaatcactcatgcctagtccatgggaagctcctaacaaaatcactgctatcattgctgttctgactataattagtaataacatgattactgtttttgtagttttagttgtcatcttgctgtagtcctgagaaagcctcaattcccttctcaataaaataatgttgaagattcagggaaactttaaaatttataatgaaacgaacaaaaaaatcttggatgaagtccaagttacatttctatttttggcctgtggaagaagtttgcaccaactctcggtagatggaactgggttgagataaatttaggtaaataaaggttggacgacctttgatgttccctacagaatccactagaaagggtgaggcaagatgggcctagatgctgcattttgaagatctgaagatggacaaacctttctctgatcatttaaaaagcggcttgggtgcactgggggtgggagtatggctgcatagagtccagagacccaaacttggagaattgccaggtctccacgactctacccctgaggatggcctctggaaggaaaaagaccacaaccaaacactgagaaagtactaggggacgtcatcttgagacctcagctagggtacatgcctcagtcagaaattaaccacggcaactggagcctgactctgaatggagcctgagaggcaggagaagaggcagccagaagccatgagaagcatggagggaaaggcttctggagaagtgaagagacgatacataaaatttgtttttaatgtgtgataaaaacattttataaagtgatgagctgcattagggtgggaaataaagtaaattatatggtggatgaattcaagtgtgctactggctgtgcagaagaaaagacaggcaagacagaaaataataacctaatgaataacctgtttggaaagtttcagattgtataacaaagccagagggagagtaaaacatttgcagtttctcctatgacccggtagagtcaatattcaaaaaaaaattttagtattacctttaaaaataagaggttaaacaatttttgaaaaaacttaaaactgataaaatatttgacatgaccactggctcaaaatgaaatcaaaaccatagttataaggtataaatatattaaacatgagatctgatgcggtagctcacgcctgtaatcccagcactttgggagcctgaggggggcagatcatttgaggtcaggagttcaagaccagcctgatcaacatggtgaaaccctatctctactaaaaatacaaaaaaattagccaggcgtggtggcacgtgcctgtaatctcagctacttgggaggttgaggcaggagaatcgcttgaacccagaaggcacaggttgcagtgagctgagatcatgacactgcactctagcctgggtgacagagcgagatgccatctcaaaaaataaaataaaataaataatagagtaaaataaaaataaaaatagaatataaaaaattaaagcatatagccaagtatgtaatcagagggacattcatgctttaaatgctttcattacagatgagatgaaacaaagtgaactaaacaaactactaaagaaattcgcaaggccgggtgtggtggctcatgactgtaatcccagcactctgggaggcctaggcaggcggatcacctgaggttgggagtttgagaccagactgaccaacatggagaaaccctgtctctactaataatacaaaattagccagccgtggtggcacatgcctgtaatcccagctacttgggaggctgaggcaggagaattgcttgaacctgggaggtggaggttgctgtgaggctagatcacgccattgcactccaacctgggcaacatgactgaaactccgtctcaaaaaaaataaaaaaagaaggaagaaattcacaaaaggcactgcacaggaaggaggacgaggagaaggagaaaggaaagaaggaagagaaggagagaaagaaataacacaattgcaagggaagccttttaatttgaactaaatctgaaagacaccttttttgtttaaaaaaaaagacaacctcttgaaacaaaaaaagacaaacaaaaattttaaaaatcaggaaaaagaaaaaaggaaattgtcctcaaaaatacaaaattttgttcacgttcaaaatactgcatctgatatctaggctttagaggtagatcattttatagatgagttctttgaacctccaaagaaagaattagttcatataatagataaattattcagggcattaaaaaaaatagaaccaagttacccagttcattttatcaagctagtaaaggcacattaggccaaagagtgacaaatacaacacagaataaattaaagttcaagtccaatttcacttggaaatacagatgttgaacacaattcaactattcatgaaaaaataatctgccccataaagaattattgatcctattaatgcaagactagtttagtatgagaagatagatatttttgtatgtttagagatccaatatgaaaaactaagaatccttctatttgccaaaaaatgttcaaagaatttcaaaactatttgctatattttaaaagtgcaataacaaatagaatactttatagacatcattttacaaatctcacaccagcagctattatgcttaattttaaaatgttaaagacattctggttaaaatcaggaataaaataatcattgttattattttatataattctagtttacacagtaagatgtggaaataaagaaaaaaatcactaagaaggttaagatcaaagttattagcaactgcagaaaaaaaaaagattttaaaatccaggaaaattatttaaaaaatttctgagcattaggaagaaaattcaataaagcaacaagaagaaaacatcagtctctacctcaccaatataaaaaatccttaacaggtggggatattttcacaaacattagtaatataaagcactaaggaataaattcattttttaaaaaaccattttattatgaaaaataaggaacaaaaggctatgttctcagactggaacctgttgaatattttaatatgtccattttcctcagtgaatatgtagttctaatggaattctaatctaaaccccaatgtattttttcctggaacttcaaaaatatgactcaaaaaccaaaagaatgagattgtacaaatggcttaggtattttgtattaatagttttcaagtggattatttatgtttgatcactacagcagtatcataaaataactcgcgtgacattctcaaatgttgtcaacatgatgtcaaagttggcatcccaaaattcctgagcgatatttttcaatggttgtacagaaagcatctttctgttaaagttgtcgtgttttatcttgtttttaacaaagctgagacaaattttcccactgactttcactcacagttcaaaaatgtgctcttacaggaaaacctaaaagaggggaagggaaatagcctccagacacataaacacacccgagaagtcagatgaattctatttaacaacaacaaacaaattcctaagtattatactctataaaggcagagtgtcctggaaatgccatctggtgccgtgcaatctggattcctgtgagtgccagggacaagtggctgaaccgcaatgagatacggccaaacaccagaaacttcacgaaagaatattatcttgtaaatgtgttcagagaaaataattttgtccatgctgtttctgtgtgtgtgttttagattaatctttcccaatattttatacagcatataaagcatatagcgtatcaagtatataaagtatatatattgaaaatggagtggcatcctgtttctgtttttacaataaaggagacacttcttgagaactaagctcaaaacagttcctggctcactcagagtccttagtacttaactgtaggaatttcaaaatgatgaatgtcagatggtacaatacagaagaatagaggtaaattgtgaagtcagagagaatgaatccagatgcaagaacatcaattcgttctcacagttgcctgcaaactatggactaaacacaatgattagaatatctatttcatgtaaacatgctaaataatcgaacatgtaagttcaatcagagatgcaattaactctgcacaccaaaaatcaaagtgatgaagctgagcattcgcgaattgaatcagttcccttcgacgctttcatgctcccattaatatgtagctgatgccactttctgacttcgaaggacgatttattcttctgaggatgatttatatgagttgaaatgatacacttctattttattacttgtgcctactgaccttgagccactaccaagtcacagagattcacatcaaaagccaaagtcagattctgtcaccaaaactcatggtctcagggattctgtgattttttttttctggcatctaaactctgtctataaacacactgtccttgtggactgtaattactcatagaaggaccaagtgctgcttttatgaagtctctgatgtttgccatatctctggacagtcgtgataggaacctgatgagttgaaagctgactgtccgtcagccaccttgcctttcttctttctacaagcctatattattttaattgcagtatgctgctgctgattcttaactactttgccctctacaaagacattattagctaaagccctgtagcatctttgaagtaatgattcatttttttcttaaatcaacataaagttagcggactccctggggcattctcagcccaaggaagaatcacaagtatgcatccctgacaaaaaagaagcaagtctgttttttcccaaagttcttcagaaaaaaagtatcccataatttatcaggtaatgcattccagtgtctttattaactcaaaaaaaaaatctggtgtttaaccttatgccaatgtgtgaaaaacagaacttcactataccttacacaaacaaagctaatccatagaatcctgaacacaatgaggcatttcctcatccattccaccactgtcttttcatcaggattctgagtaagttgattttttaaaaatgaccctgattcagtatccagcttagggttcctaacattgaaatggaatcattcatcaaggtcacaattatgaaataatgaggtttccagactagaatctatgtgtttacctagtttcgttataggcccaatttaacaagtaatacgaattgtgatcttaggtaatgtagacttctattacagaccagccatagattcacggaaaatatacatgctaccctggaggtgcccttcactatccttgcacccattttctattttccacccatgcaccccattttccacccatgcacttggccaggaagcagcagaaaagagagattaggaaggcctttctcaggaactcaaatctatatcgcatgatcactcaggagcgttgggatataatgcgcttgcttgctaggacacccgtaacaaagtaccacagatggagtggcttaaattacagcattttgtttgatcacagtcctggaggctagaaacccaagatcaaggtgtcagcaggatcagttttctctgttttctctgtggactctctccttggcctgtagatgaccgtcttctctctgtcttcatgtggcttctttctgtgcatgtctctgtcctcatctcctcttcttatcaggatgccggtcatgttagatttaagacccatcctaataacctcattcttaactgaattacctctttaaagaccctgtttccaaatacagtcacattctgaggttatgggagttaggactgcaacatatcaattgtgtgcaagtgaagtgtggggacacaatttagttcatagcatagagaaagcatcagcattgcagcaacatttctcaaaaaaatgatggagttgttcaacactcctgacacaggtgaaccccgctggcaaattagtttctcaaaagcggaagtgggcagaacaaattatatttccttatgtgtgtgtgtggagaaggggagacaagggattcaagctgaacaagattattatttcattagcaacatggcagacacgcagacacacacacacacacacacacacacacacacacacacacacacacacacacagtcttataatcatattcatctgtttcttcccggacccctccttccaatgaaattccttctctttacccatctggcaacaagatgaatggcagcttttctagctctaggttgagtaactttcagttactgcagggagcaaactgcctttctgacaagaagaatgaaatatgaaagggtgacattgggtgtttcaaaactcctcctcagtatcttacagatattgcacgtgcttataacctggtacaatgacaaaggaaaaaaatgcctgtttctctgggaagcaagaaccaccatcaatagactgacatgaactaaaggaaatctaaatgctagaaatgatcaatgatgattagacaaatactaattttaaagcatatctatgtgtattgactgcaaatacttttgtaaagttattccttcgtatattgaacaattttctccagttcttatcataacagtttttcacatgttctatatagtttataagataactaaacttttcccaaatcaagtttacacaccaaaattatagttcctcttctttcttgcagtcatattgttaccatttataaccaaaattttgcaaaaagtgaagagaatccttttttttagaatgaacaatttcttaatttaatataaagtttctgttagagtgagattaatgtgatgtacaggggcaaaactgcccaaaaggtcattttatgtagataacaaaacagaagttagatttcccatcttcagaaacatttaggacgatgttgagcatgaaatccactcctagagctgtatgttttaggttctctcatttctccaagtcagtcagtttaaaggctctattcttcttgtttcccttaaaccttggaatactcttccaaataaaaatctatcaaagacctgtccaataagtgccaaatacttctaacaattttgcatgtgtgggtgtaaaacaaggcatttattcattaactatgtatttattaaactcttactcttctagtgctaagtcactgctcctgaaccagggaaaattttgcaacccgccctcaggacatttgtgatgtctgcagacattttcattatcacactggttgggggagagggttgcaactggcatctaggtaaagaccagagatgctgctaaacatcctaaaatgcacaggacagcccctccaccaaagaaatatctggtccaaactgccgttggtgccgagggggaaaatctatgtagatccttgaaaataaaaagaaagtcatagataaagactggaaatgattagaaacccacccggctgagcctggcctaaattgtcaagcagaaactatgagttaaatagttactgtttcaagcaaatacgtttgaggttgacgtgtttcacagaaatagttaagtgatacaaattgttaattgaaacaatgggcctgaatgagagcacccaaaatgatcttgtcaaaccagaagacataagggcagaaggatagaaggatggaatgctgacgagaggcaggtttcagaggactggtggagagaaagagaggagccagcaaaagtaagggcattgggggtgggggtgtcagatggagggagaaagaaaacaaggaagacagaggtaagagagtcagcatgaacagttacaggaaaggaggggaaggcaatcagatgaaagggagaggccagaaagagaaaaagtattaataggaatatcctgttaaacaatacctctttaacttcacaccttaaagaaaaaacaaagctagattccaggaatttgtttttaggcacagggaccacagttgggctgacactttactggcctcctgaaagaatgaacagataattgagattctggtcagtgcccataataccagaattaagggcaaatccctctgccaacagctggagaactgtcctcactgggcagtgaagacatctcatgtgtagccaccaagatttcatcatggccatggcttgtcactgtcaggagcactttcaggtatgatactgttaggtggggctatagatttgaaaacttgtcaaaccaacatcctccaaacagaaggctgaattaaaaacaataactaagtctataatactgatgggtgctttaggcaatgaagctcatctgacaggtccagcaggcatttgatagaaggggagttgttccagggagcctgtactctgtagagcgtcatgagggcacccactggtggaaggagcaacagggccacatggagagaagagggggactgtacctgcacaggggctccaacaacatatacacaaagcacccctgatcagcaggagtgacaggaatgaggtagaccaatccccggtaagctatgaggaccagcctttgagtggaacttaaatggccaccaagaaaccatgtgaccttcctcagaacatgaaagaacaaagtcttggggaaccttggcattcctgtcactctccatgtgaagatttggaagcttgcttacattgcatctgtgcctacaactgtcctaggtcagttggagtggataaggaggcaggactggatgtcagaaggagattttattcatagtcttcaaaggtaaagcatagctgctcttttaactactagactaaatgcatactcatagaacacctaatatcctaagtccaagattttatttaggagtgagagattcaactttgcagtaatagaaactgattccaaagtggtcaaagtcataaagctgatttgtagtaaaatcacacaaaatattaatttgccctggatccctagtctagaaaatttttgactgcactatgttgcacttaaacaggaaatattaattggcactctgataggtgaataaattcagggacaagaactgaggtgcagcgattcccctatcactagacagagctaggatgaaattcaaatccagatcataagtgttggaccccatgagcttaagagtaccttaatttttgttttatgttatgttcttctcaattttctgcattaccatttcttccctcaaaaagttacacctcccccagagtatcttctttttttattgacccatgttctttatctactttctgcagcaacagctccactgagaaaaaaaaaaaatcagatattacaaatctaatttagtaacatgaaatagttcccatgagctgcaagctggctgctcgtgagctgtggtgagatttaagtatttaaatgtatacggttaataccctcaaagcacagcaaaaggcagttcacgatgaagaaaccaaatgaagtcatcctaaaattgcagattttttaagaagcagaaacatacagatttcaaaaaggataaggaaaaataatggacagatgacatgaaaaattagttcacacacaaaaaagtggtagacaagtggccaactaatatacaactgaggttcatactaacttataacagaatgcaaataaaactctagtttctcattcttactatcagattgctaaagattaagaattttaataacactcaaggatgataagagagttggaaaacagacattttcatatattcttaataggaatgtaaattggtgcaaacttcttgaaggaaaatttggaagtaactatcagaatgcaaaatgcacatgccctgcggtgttaccagtttacttctagcaatctatccaacaggtgtaggtgcacaaatgagcttacaagtttattcattgcaggattatttgtaatagcagaaaactaagcacaagctaagcactcattagtggctaattggttgttcttcttcaatgggaaaaaaaccatacaatcattctgtttttaattgaaataaatgtatacgtggtcttaggctgaaacttcacactagaattaccgcaaaaaaaaaatcccacaacaattcagaaaattgcgtgcaagacatgcatgcatgtgtataaagaggcttctctgtgcatggaccattaatagaccaacaccagaaaactattcagagtggctacccctggctagaagttctaggggaggtgtgagtagaaatggaagatgatctttaatttttatactatgctcctttgtcatctttaagttatatcttgtgagcatgcatgtattgctttcctaataactaagctatttaatgaaaagaagtcacactgcttcagataagtaaactaaaattaaaattcagttctgattgactgtatcaattctaagtgtcattttggccaatttagtcctgaacccaggggattttagagtcgccaactttgctggtgtgtctgggattgaagggtttctgggatataaggcttttagtgctggccaagcacggtggttcacgcctgtaatcgcagcactttggaaggctgaggtgggcagaacaactgagatcaggagctcaagaccagcctggccaatatggtgaaacaccatctctactaaaaatacaaaaaattagccgggcatcgtggtgcatgtcggtaatcccagctactcgggaggctgaggcaggagagaattgcttgaacctgggaggtagaggttgcagtgagccaagatcatgccattgcactccagcctgggagacaagagtgaaactccatccccccccaaaaaaagacttttagtgctaaaactaaagcagttcagagaccagcaggtcaccttactgggcttggtgagaggaagggacctgggtgagtgaggttcctctacaaagaccaaattccccttaggtggatccaacagatcaaatggaagaagctagaagtccctttggccctcatacctaaatcacattctccaaaataagttcttttagaaataaatacaatgttctgatctccatcagaactgagggacagaagatgggttttattttaggagacttcctcaaacccacaacaaataattatatacctgctactacaaactagcaccatttcttatggtgacaattcaaatgtcctcaccccacttttcaggagtgttgaggctatcttgggccagtggggaagggaggaagtagagccctggccatactcagaaccaggggaactggcctggcctgcgaagccacaacccaaacacctgtgaccaaaccaggcctctcaggccaagatatacacaagtaggaactgtccagtgggtagacggggtcttccgagcaattcccagactctcagaggccacagcgtcattcatggttccaggtgctctgtcctattctgagcaaaactcaaaagcactggtggggaccaggctagtgagagttagacaaaatgtccatgctccaggaaacaatgaaaggttttagggaaatcatctttctcattaagggagacaaaacatcagaaaccaaagaagttgagttgtacagacatgaaaaccctgctgtatctgagtagatgagagggtaggagggagaaaggcaggcagaataatggagctcagaggatatttgagtgctcagaactcatcccatgctacccgacggagagcagagaggaaggcttggtccactccctgggtgctgctggggagggagctgcaggcatggcaaggcctgtcttaagcaggtggtagaattttcagcctccactcccccgacagggcagggctggagaaagctggccctgatattaaaggagtattttgaagtattaaatgatgcggtttttttaaaaaatatttttcttccctttatttctctctatcccaaagcgtcccctgcacacacacatatttattagttactcagcttactcttgcctcaggatagagatgagatgcagtgaaggacagaaaaatcctaagctctttaaggttcttatttctaacagcagtcactgccccagagccaagagaggatcttaggcagagacaaaatacccaaaacctcaacaggagatggatttttctgaaggctcgggaaggattccctcaggctggtggtggagctgggagaagaatgagaaggcaggaagatgggaacaaagagatccatgagtcctgcagactcccaactccccagcacacctccaaccccaggatgacatggcagaccctcaggagggaacaaaggcaggctacgcccatcctcatcatccaggactctcaatggcccatcagacatttccatccccaagtcatcttaaaagaccagagaactatttgacctgaagaaaacacacagccagagcaaagtgctgatgttgggagttcaagaccagcctggccaacatggggaaaccccgtctctagtgaaattacaaaaattagccgggcgtggtggtgtgtgcctgtagtcccagctactcggtagggtgaagcaagagaatcgcttgaacccgggaagcagaggttgcagtgagctgacatcgcaccactgcactctagcctgggcgacagagtgagactctgtctcatacaaaacaaaacaacacaaaacaaaaaggcacttttgcagctctcggtgcaagccctcccccaagcttttgttctgtgtaacctcatggaaccctagcacaactcagggagggaggtggtgcgaaataactgaggctaactactgtgcaggagctgcaaagaccctgcagatgcccctgtgtcactcactggctagaacaacactttgctcacagcctctccctgcaaacacatgccactctctgcctggagcttcttctcaccagagtttctggatgagctgactcatgggtctcagtgtgaagctttatctctagcgtttaatgaaagtgaggagacagaaaggactcaactatgaatattctgtctttacggcgcaagctcctggccgcatagatcagcatttgaaggcagccgaggaaaatgaaacaaacttcaaagtccaaagaggaaaaaaagaagggcccgtagaatattcttcaaatgaaattaactgaccaccagatgctctgaggttttcaggctactcagcttaaatcagagggagcgtatcctagcgatggcaggccctgttcggccacagactgtcactttcttttggttctcaagtaagaatccttgaggtgctgtgccgcagagcagattcaattttgttcacttaattttcatctctcctacatggttttcttctacaaaaacggagataccattttcttcaagggccatttaccatataaagaaatacatataaagggagtaaaagaaaattaatataatcatgtcataaggcaatggatttttgtctctccttttacacagtctgacttttgcatacattgattaaaagctccaccagcgtctgtcacatactatttatatggaagctttatcacaaaacagaaacaaatggtctctttttttttttcttttcagtcctcatgactgctacctgggtttacgccctcttcctttcatagtttttatctcacccagcattcaatcattaaatcttggggtttggagataaggcctttctctctcctgtgtatgtcagaaatgctttccggagaaagtcatggaatgcccaacctgtgctgacttaaactctcgacatttattgctatgtaacaaaaagttctagggttgattggtggctcagcagtatctccaaacacccaggctctgtctgttccccaactcagccacatcaagcataataatttcttacctcactgtcacaaaatagctgccacagctccaggcaccatgctcccacacagttatattcaaaagcaagaaactcacgaagaaaccagggaagtgagagtgcctttatcctttagctctttcttccatggagggagagcattaggacaaatatctaatgcatgtggggcttaaaacccagatgatgggttgatgggtgcagcaaaccaccatggcacatgtatacctacataacaaacctgcacattccgcacatgtatcctagaacttaaagtagaaaaaaaaaaaaaaaagaaaagaaaaccctttccagaaataccttccacagactcactcattggctagaagtgggtcattgtttcaattatagggcctcgctgatttttaagtaactgccagttcagtttctttctcttctttctaattgctgcattccccaaatcatcattctactgaaccaatatcctcctaaaaggtccctgcctcaaatctaccctccataccaatgctactccagtactcagtaaggtggccagtcttcaagaagcccccatgactcctgcctccttgcatttatacccttatgaagtcccctcccactggttgggtgtggccaaaagaacatggcagaagtggtgggattttgtttctgaggttagatgataaaagacactgtggcttccgtcttggtctctctcatcccttctctgaggacagccactgccacattttgaggatactcagccactctctggagagatccacagagcaaagatggatgcctcttgccaacagctgcacaagtgatcttggaggtgaatccccacccaagtcaagccctcagctaacattgtgactaacacctcatgagaagctcgaagctggaaacacccagctaatctgctccctaattccttacccatagaaaatgtgagataataagtgtttgttattttaagtcactaaatttgggggtgatttattatgcagtgatagataatgaattcacttactgtgaaactgtcttggttaaaacccataaatggtctctaccacttacagcagaggacctggcattgccagtaggtgagttttggtccacggagtcttttgaaatattttgaactgatgtttcaaaattgggagatgttaaatagacatcataacatcttgccaaccaggtccacatttccacagaacacccaaggccttggccagaggattggctgtctcctttacaaagagcatgccttccaactaccaaaggcctgggccaaaggattgcctgtcttctttatgagagcatgcactccaactcactgagaggattggctgtctcctttacaaagagtatgctctccaacttatcgagtgccctccactcacccaaggcctgggccagaggattggctgtctcctttacaaagagtatgctctccaattcattgagtgccctccactctaattcccccaatagtagtgaggacatgtcatagttgccactttttgatccctgcatgaaccattactttagttatgtctgagacatagttttgtgaacctttgcccctaccaaaaatgggcaaacaaaagatagactgaaatatctctagtaaataaaaagctagaaaaggtttccgcacacctaaggaaacagtcaacagagaaagaaggtaacctatagaatgggagaaaatatttgcaaatcatacatctgataagaggctaatatctaaaatatataaggaactcaattcaatagccaaaaacaaaacaaaaacaatccacaaatgacctgattaaaaaatttgcaatggattgcaataaatattcctccaaagaatacatacaaatggccaataagtatatgaaaagatgctcaacatcattaattattaaggcaatgcaaatcaaaaccacaatgagatagcaccccacacctgttaggatggtcattatatatatatgcatacacacacacacacatatatatataaccagattatatatattatatatataatatattatatataatatataattatatttatatataatttatgatatatatttatatatatttaaaaaacagaaaataagtgtcagaatgcggagaatagaaacccttgtgcattgttgatgggaatgtaaaatgtaaaatgatgcagcctctatgaaaaacactatggagatcatcaaaaaattcaaaatagaatgaccaagcggaatccagcaatcccacttctgagtatttatctaaaagaactgaaatcaggatctcaaagagatacctgcactcccatgttcaccgcagcattattcacaataaccaagaggtggaaacaactgaaatgtccattgatgggtgagtggataaagaaaatacagtatatccatacaatggaatattattcagccttacaaagaactgaatcctgtaatatgctacaacacagatgaacttcgaggacattttactaaacgaaataagtcatcacagaaggacaaatactgcatgatttcagttatatgaggtatctaaagtagtcaaactcacagaagcacagagtagaatggtggatgccaggggctggtgggaggtggaaacggggaggtgttcgataggtctagagtttcagtcacgcaagagaaaaagttccagagatctgctgcacaacagtgtgcttatagtttacaatactatattgtatacttaagaatttgataagagaacagacttcatgttgtatttatttatttatttattttctgaaatggagtctcactctgtggcccaggctggagcgcagtggtgcaatctcgctgcaaactctacctcccaggttttagagattctcccacctcagcctcctgagtagctgggattacaggcacctgctaccacacctggctaattttttgtatttttttagtagagttggggtttcgtcatgttggccaggctggtctcgaactcctgacctcaggcgatgcacccacctcggcctcctgaagtgctgggattacaggcatgagccactgtgcccagccttatgttcaacgttttttttttttcaccacaacaaaagagagaaagagagaaggaaggaaggaagggagggagggagggagggagggagggagggaatagaaagtggggtaacatctttctttgttagagaatattttcatcttttaacatgtaaacaaagtgtctaacaactataagcaggtctcagttcactcatttatcttacctgcctggtccctttaggcatcagtgtttattatcccaggtctacagggcagtggtgcttcataggcacagtccaggttctctggaatccagcccagaccaccaattcttgctgtcttaccactttgtgacatgtctcccactgtgatggttcacattatatgctgacttggctggggtatggtgcccagtagtttggtcaaacaccagtctagatgttgctgtgaaggtaatttttagatgtgattaacatttaaattggtggaatttactaaagcagattatcttccatcttgtaggtgggactcatctaatcagttgacagtcttaagagcgaagattgaggcttctatagacgaaggaattcagcctcaaaactgcaatacagaaagcctgcctgagtttccagcttgcctggcctgccatgtggaattcagactccagactacaacaccaactcatacctgaatttccagcctgctggcttgtccaacagattttgttcagcacgcacatcatgtgagtcaactctttaaagtaaataaatgtgtctagcacgtgcgctgtctctctctctccttcctccatttattacacacatacagatgggtgtgtgtatgtatgaaaggaatgtgggagggtgggtatattagttagggttctccaaagatgtggaacaaagatacagaacaagtgggaaagacagatctttctgtatctttggagaaccctaactaatatacccaccctcccaccttcctcacaccaccaccttctatcctccatgtccttggtcatgcacttggccctggtcatgccacccccttccaccaggacatcttgccctcccatccccccagcaatgcattctcctttaactcagtccaactgtcaccttgcccaggaagctccccgtgaccacgcagactgggatatatttttctccccgatgacgctcgtttgtgcagatccctctcaacccacacattaagttggaacatgacaacttcctttatgtggcccaccagaagaggaaccgtgtcttattctgtcaaatgaatgaataaataaacggatgaatcccaacgtgttattactgaggaggacaaacataataatcttagacaaaagtagttttacagaattaccatgtaaatcaccatagaatagaataaatgctttgtaatttagggggaaacagaaggattttctgggcttctggcaaagctttttcctaactaaatcatttcaggcacagcttttgcaaatgcgtcttctgctggtcataattatgcgactcccaccccccactgctttgaattactttgtgctaacaccaaaattgttccacagagagtaggatttatttgctgaaatgtgatgaggagaagtgggataagagacatacttcacatgcggtgcctgttgctagcacagctgtatttctgagaaatatatttcagtcttttggctccatttcttttgtagtttaataactgaagtacaaagctcatgaaagctgggaatgtgttggaaggtcagtgaggaaaaatgcacgtggtgcagttaggagagacaagggagttaaaataacaggagaaattgatcacttacgatctttctggttggtggtttatggctaaatgtctgtttcagctaaagaccaaacactggctcacagctacaaagaaagtagaacaattaaaaaactcagcaaggagaattccttttgtacctctattataagcatattgtttatttaaaattattttatgtaatgccaatagagtaatatcttcatgtcattatataaatgtaatggcagtggctagttttgccattggatgacagtcctacacactggaacacattttctcacctagcagaaagccttgcctgcagcactcaccaaatgcctcctacagtatcttcctcatgtgcacaaatggctttatgtcagaaatcaacatccactgagacaccagaaatttgaacaggtccctaaagacaggttgactgcttttcctccctgtggcacagtcatttgcagtctttacttggtattgcatctgtaaatgggatgtagataatatcgccatcatttccagggaatatagtgttatccacatcagcgttcatgataacaaacacaatgtcccagctgaactttgtaatcagtacttttgggagaaccaagtctgttttagtttaacagatgcatctgatgttgttatctaaccatctgaggctgtgatgaagcacagaacgcaggctttgtcatcagccagtgctacaccatatccagggccggcttcaccagatgtgtgatcttgggcaagatgttttgcctctctgacctgcagtactctgctctgtaaaggaggtccataaaattctctttggaggatcaatatgaaaatcagaaacaataaattaaactatctggaatagggattggcacataagagatgacaaaaaacaaaagaaagtgtttgtaatagaatatggctgacactattcctgctggttcgggattctggctgaagctttaaattgagaatggaagaaaagcctttcatgttccaaaggaaagtgctgaacacatttcccagcacttctgaaagatcgaagagccaatctagaaacagaactctgtgtctagcatgatacatgcaatatgtgtgcaacatgcaacttgcatgtatatacacctatattatgtgtgcatatgtacatacagtatctatatacacacctacacatatgtaaataaagctcattaaacaggatgtgccaatttgtcagccaatggggaattgatgtggattctccctccatcatgagagagggaactagggtgctcgtccactctttcaagctaaggaaaggggactccaggaagatatgtcaaaagaaactacacacacttcaagagggagagattggcaccttgctccccagcacagccagtgcactacagactgaacaaagtgtaaagggagctcctgaaagaactaaacgtgtgtgtgtgtctaggaatttggggcatatggaagcagagactgctgcctctcctattctgaataattctgaagatgggaaactggcaggagcagtgcaccataaaagccagggaccgaggatgcacttggggatgctacagcaggtggttgaacctcacagtttgaaagcacccacccaattgggcagcctgctggactgagggctcccagcaccaggaggctgtgggtatgaggccattggaagcaacaacagaggagaactgcaaaaggccctccatacagcttattgatttatttggagaggcttctgcggggccactaggcaaccacaaaggtgctcccaagggagtgccagctttggggaccagccacatgcataggggacaggacaggtgggtttcaacagcctcatgtacaggagacttgtcctctttcctccagtctgttttcccccaacccctgccctagagaggtgaggagaaggaaggagaccccaagccagggaacagaagagctttgaactggatgggagactgaagctttccctctacctagattgttaatacctgacagtgaatctcctcttacaaactgagccagagcatcaagaaggctatgaacgaatctccctgagatgccttcagtgagcagggaagggaaagccaacagagcaagattgaaatataagtgggagaaaagtaaagccatttcctgtttatatacttcagccttcagaggccacaaaaaaccagctacatacgattatgttatttcggagcctccaaatggagtgacacatactcttttactgccaattaccaaggcgtggaaggtggagagaggactctctagctcctctgctccatctctttgtggctatcacattggcttcaatacaatgtgacttaggtacccaaattattctagtattgagacaggcaagtgtaaagaggtccctggagaaacttcaaccagcctggtcactgggaggaatgtgcgctggggaggagcctcgggaagtctgtgccattttgcagcagggaggagcctggcctctcttgttctggggtggggaaactgggattcaatctgtgaggcaggaagccagctagcaggactctggttttgctgagagtccctgtttcccttttttcccttttcacccaataaaccctgcttttctcacccttcaaagtgtctctgagcctaatttttcatggttgtgtgacaaggaccctgcttttagctaactaaggagaaagtcctacaacaatatagtgggacaaaacccagagacaacaatcgatttcagccaatccagattctaccaagtctgtaaacagtacatatattatatatatatatatatatgcttacagttacttccaaacctctttttctcataatcacccaaacctagactaatgagttcccccatttctgctctcaaaatttctccaaacaagcccttttctctaggggtacagaattcctcataagctgaatttgtaccttctctttgtactgtaatctatgatcatgcataagtctttctctgaaggggaaaaaatgacaacttttgacttgaaatccagctctggatttacctagaagtcaagcttgttaaaatatggtcctcagggtttagaagacgagggtgagctaattctgagtctcagcctgcctaccaaaccagccatacgatcgatacggaagacagataaaaccacacaggactcatgccttcagcatgaccagacaacagagaacactgcaaccttcaaattgcctgaaagtaacaaattccaacagaactctcaccacctactcatagctgctaagagcctgtggatgcagagagcagagagggaagcagaaaagagctaagaaaataaacagagggagcagagggccacgaggaagcacaaactcaccctagaaagaggaaatgaaatagacaatgcaaaacaacccaataccagtcaggacttggagatgcataggaaggcactggagagtgggtggggccagaaggggtggcctcagaacatactacttgtgggggataatcagatctaaagaaaagatctgatgttccttggagatgagacagagacgggaaagaaggacttaagaagggggaataaggagcctgcagaaacacaacagtaaactagaataagtggagagaccccttgctcttgatttggaggtctcggtgttatcaagatgtcagttctccctaatttataaatgtagtgcaagaccaacaaaaattctaaggagctttttaatggagacagacacattagaaaacaacacacaagaatatctaggaacacatcaaaaaggaataacttggtgggggtgagaaagggataataccgctaccagatgttaaaacataatatagacttcccacaattaaaacagagtggcactggcacatgaatagactgacatcaaagaaacaataaaatgtcaaggaaaagatgaaaaaaaagaatttccatttggaaaaacataaaagtagatccatccgtcaaaccctacataagaatgaactctgaatgaatcagaaatgtaaatgtaaaaataaaaggacatatactagaaaaaaataaattcttctacaacctatgtatatagtaaaaggctaggtctgacttaaaatttaaatgcaataaaatactaatatgtttgtttgcataaattaaaattttaaaaaaggttgtatggaataactacaccattagtaaatttctttttattttattttttattttagatggagtctcactctgttgccacgctggagtgcagtggcttgatctcggctcactgcaacctctgcctcccgggttcaagcaattctcctgcctaagcttcctgagtagctgggaccacaggcacacgccaccatgcccagcaatttttttttttttttttgtatttttagtagagacggtgtttcgccgtgttggccaggatcgtcttgatctcctgaccttgtgatctgcccaccttggcctcccaaagtgttgggattacaggcgtgagccactgcgcccagccaccataagtaaatttttaaatgacaaaatggaagaaaaatttgcaacatacattgcaaatagaagaattaatgtcactaatgtacaaggcactttgcaaaatcaaggatcaaaaaccaaaagtcctacagaaaaatgggcaaacacatgaaaaactattcattaaaagaaacagatacatggcctagaaccatatgaaaagatgctcaattttgtttataataaaagtgcaccaagaggctgggtgcagtggctcacacctgtaatcccaacactttgagaggcaaagacaggaagactgcttgaggccaggagtttaagaccagcctgagcaacacagacaccctcatctctacaaaacaaaacaaaacaaaacaaatcaaatcaggcagttagtggaaaaggaggcaacatttttgaccaggtggtcaaaattacaccacccatgtgaaggacatagtatgtgcttccagaagggatgacagaggacacagtatcttctatgcagtgggatggccgataacacacctcaacccaatcacaaggaagcttcagtcaagcataaaatagggagcattctgtttaaaaagtgaaggggctactgtattaaaaaaaaaaatcaatgtcttaaaaggcaaagaaaaatcatggaattgttctagattaaagtaggctaaagagtcatgacaactaaatgccatgcccaattctgaactgaaccctgtactggagaaaaagtgttacaaaggatattaattattatgttaactgacaaaattagaatatgggcagtggattagttaaaggtattgcatcaatgtgtgtgtaaatcaatagtgtaacatcattagtgtatgtggttatattaataaaagatatttttctacttttaggaaatacacactgaagtatttagtaggaaggaccatgatacacataacttatctgcaaatgattcgaaaaaaattgtgtatgtgtgtgtgtgtacacagagaaagagagagagattgagagaacataaatgataaatcaaatgggttaaaaacaagtgattctgggtaaagactgtaaggatgttctttgtactatttttggttttgcaaccttcggagatgtaaaatttgttttaacaaaaaacctagaagcaatacttgtttcactcttcactctccccacttcctcgcttttgtctaccctgcaattcactgttaccaagcctgggtctccactcttccactgaaaactattctggcaaaaggccccagtgcttccttaaatgggacatccaacaggacttttttaattattcatcttgcttgagtcagtggcagcactggactcttctggcttcctgctgctgcttaaaaagctacacttctggccgggcgcggtggctcacgcctgtaatcccagcactttgggaggccgaggcgggcggatcacgaggtcaggaaatcgagaccacggtgaaaccccgtctctactaaaaatacaaaaaaaattagccgggcgtggtggcgggcgcctgtagtaccagctactcaggaggctgaggcaggagaatggcgtcaacctgggaggcggagcttgcagtgagccgagatcgcaccactgcactccagcctgggcgacagagcgaagattccgattcaaaaaaaaaaaaaaaaaaaacaaaaacaaaaacaaactacccctctatgctattttcttttcttgccttcatgaccactcctctttggctttcctttctttctttttcttcctctactcaccttttaaatgtgagtttcctaagattccttatttagatctcatcttactcaacatttccctaagaatattcttccatttttatggctccaaataccccaaactggagaggcagttaaatagttgattattaaaaattgattagtatattatttagctcttgctgtatgccaaccaaccacaaaaatctctgtagcattcaacaaaaagcacttactctcgtggatctgcgggttgtagaatttggctagtctgggctgggctttcctgggcatggctttaagccacagggtgggctcacatctactcagtgagtttctcaccctctgtggaatggtgggcaagttgggacatcttctcatggcaatggcaggaagcaagagagcaaacggaaatgtggaatgtacctctgaaggcctaaggccaggactgacccactgtcatttcaacccacattccttaggccaaagaaaatcacacagtcaagcctaacgccaaggggaagcgaagtctgctccatctcaggctggaaggattaagagtctgacgagaaagagagtgactgcaggaaagggtggggaactgcacctgtctgcagtaggaatgtatgaactgacttggaaactgtttcaaccttccctggcaggaaaggatgagctacggagagcagagttcctcaaggtggggcatcaacaaggacagatgagagggaaggagcagagagaagcagtctaccttgaagattcactcagtgaggaattttaaaacctctgcatctcgaaggtttccagattttctttccaccctagcattttccagggagccccaggagtgccatgctgcacttggagggctgctgtgcccatttctcttgtcacattccattagacagatgcctcagctgctgcaatgctggaaaatctagaacatgatgtgctgttccactagggctgctgcagcgcccaccctgcctgctgcagggcagtagctaagaactgcgagacgcgaggtttcccttgcccatgtgcaacctgcttacctatataaatagatagctgatcaagccttttttttggcaaaaattctctgacaggctaggagcaaagcacatgccagcaaagggcaaaggggctctccatagtctatctttgagggttcttgtgaagttactatgtgtggcatgaaggctgcttacatttttacatgcatttgatccctttaaaatggtccagaagaaagtggtatatgaaagtacattctgaaaccagaaacatggagcatgacacttcaagctacaggatctggagtcaggtgggtgttccccggtgctgctagccagctttgatcttaactctcccaagggtcaactcttcatctgggaagtatggccaatcctaagtcacagcattatataagagtgaaacaaaagcctgtgtgaaagtccctggtgtcctgactaacccacagtaggcgctgaatgaatagaaccttttaaaggtgttatcatcatcatcatttgcagcattgctggacttttttctcttcctagctcacctcctacaaatgtgttactggattgtgacaaatatatttttggacatttttagttgacaactgcaagtgatattgaatattgcaaattaattgacagtttaactgcttagaggatttctcttactttgggtaattggaaagtaggaaattaaaggaaaagcaaatatgatattatttgagtattatttatgaaataggctcaatatttcatttcaataaaatttcatgtattttccaaaaatatctactttttctactatactaccttcaacttatccaaaataaaacctaataagcaatagtaatagtcaacagtcaaatattgactaacttctgttccaggcagcttctaacatagttcccaagaaaccctacctccttataggtggccagaccagtaacttaacttgctacttctgagaagatgttttaaaagactcttccttattaatctctctctctctcttcttacttgctcactctgatggagcaagctgccattttgtaaacctaagggtaaaggaactgatgatgatgatggtctctggccaacagctggtaaggacctgaggccctcaatccaacagcccaggaggaaccgctgccaagaggaccccccacaggggacccctgaggccaccatgtctctgactgcaacctcatgaaagactcagagcttctgcacccaacttaactgtgcccagattcctgacccatagacacagtgaaataataaatgctgtcattttaagctactaagttaaggtaattttttacataccaatagataactgataaatctacattgtactaacactatctggaagtttagatgtaatctacgtaaaatggaaaggttaaatttgctggtttctggagaaacccaatggatctctttggagacaaaatgttctctttccatgtcctttggagcaggggttgttgtggagtattattcttagaaagtgaaatgctaagcttcagcattgtgggtcagtctcaacttgcaaagcaaaagtttagatctccatattctttttacttgtattcagtagctatgttatcttcctcctttccattgcctgagctattttctgcattactgatccctcacacagccatctcagcttactacagaaaaatacctcctggtatttagaatgttcaaaacacttgagcaagcatattcacaacccatactgttgccaaggctgaataattgggcttggaatatgcctggcaccatcactccagatgaagccctagacggctgccatcggctctgctttgcccttactgcttacatggaagtggtcatttaggctgtgaaatggtcagacagaggagcttaccactaagaagcctctgctgcatgacaaacaccctgcctcaaagattgtgcctaattcttgagtgggcaacctgcctctaaagcagatggatagagtgaaagcaggatggagatggagagcgagcacagaaatatttcagtctagggtcatattggcatttgggagcttgtcaccatctgctgttcccggggttcccagcttgctaatccagcttgcagatggattgacatttttcaatttcttaaatcttgggaagagttttggtggttctctgttgttgccatgaagactgggcctgttctctgtcaaaatgcagccaaggtctatagctaaggtgcctagattctaccacttcattatcgtgggcttctagtcttttcccgaggggagagtgcactgataattgtggactgcggggcaaaagcttattacctgtcttcacattgtgttgcatgggcccaacagcacatttttataaagagaagacaataaatttgaagagatgaggccaactcctctcaactcctcaactcctgccacacctgttccccatgactggccagtcatggacaatatctgacaaacactcccccttcccagggctccttccattaggatcactcccaggtgtgcagtgccaggaagaggggagatgcccaccctcactgccaaggagaggcaggggtgtgccagggcacttgggtgcagggatgagccgccattggcaactcagctggccccactggccatgccctcgcaggctctcagctttctggtgcacctggtgatgctagtgaccctcatcaggggtgaatgcacctggctggcatgatgaccagttgtgctgccgggcacaaggctcccagctgctctttgctctcttagtcctgggaggagctttgcactggatccagggagaaaggagtagcgcttggacattggtcccaatgtcaccgaaataaggcagagggctctttctttgttcttcctcattgttcctttgggatgaccctgtgacctatgacctgtggaagatggagccatctcagtctttctcctgttgggatgtggggatgtagttgagaattgcattgatcactttgcaaaagggcttcttcgtgaagacttaaggaacagctcatgtttcagtgtcaggaagaacagtcttcaattcctgagaaactgaccagtgcatgccttattgaaatgcaactgtggctgatttcatttgcatcttcccatcggccacattaggccaagaaccatatttgtggcccaccttccaccacatacaaggctgtatggccagcaaggcaacctttttttctggctctattttaacttcagaccctttaatctttatttggccttttaaaaatgcctctcttagatgtttctttcttttttttttttttttttactatgttgaattattatatcctttaaggtcattttccctgttcttttgcaatgaaatagaacataaatagtatacttaacatgctaaaataaacttttctcccaactgttatttccaagacaaaaatccattttatatcctatcccaccatgtagggactgcaaatgtagtctttatgttgtccttaagaaaatctaccaataagataaagcattttccaggaaaccactgagacacattgtatcctattcctgtgcagattacggtaataactgacaaatctctgatgtcacagagccaggtggagcacaggaatgacttcatttcttcaacaaatatgagttttccttgggagagctttgagcaagtcttctctggtgtgtggcttcagggcatattcatgtgtacccacttggctggacactgggagcagagtcagaaagtgggtatggaggcacttctctcaaatgactttacaatttaggagaaaatcctggttgcaatgtaattcttccagaagcaatgactaaatcagtcaattcagcattatagaaccatgcaagtgtgtgcattaagccctggaaatactggaggcattttgtggggcagcccatttgaaacacattggtgctgtgcttctgtgatttggtaaccagcagccacatgggccacctgagtcaccgagctgcctaaaatccgtagtgtacaggtgatgagggggactcctgagagaagggggtgaactaggtgatggcatcctagtgagaggtgacagcgtgctggcagtggtgacagcgagcccttgctcgctctgggcgcctcctctgcttgggctcccactgtggcggcacttgagcccttcagcccgctgctgcactgtgggagcccccttctgggctggccaaggccggagccggcttcctcagcttgcagggaggtgtggagggagaggcgcgagcgggaaccggggctgcgcgcggagcttgtgggccagtgggagttctgggtaggcatgggcttggcaggccccgcacttggagcagccggctggccctgctggccctgctggccctgggcaatgaggggcttagcacccgggccagcagctgtgaagggtgtactgggtcccccagcagtgccggcctaccggcgctgcgctcgatttctcgccaggccttagctgcctccccacggggcagggctcgggacctgcagcccgccatgcctgagcaccgcccctcccccatccgcccccgtgggcttctgtgcggccccagcctccccgacgagcaccgccccctgctccacggcgcccagccccaccgaccacccaagggctgaggagtgcaggcacacggcacgggactggcaggcagctccacctgcagctccagtgcgggatccactgggtgaagccagctgggctcctgcgtctggtggggacgtggagaacctttatgtctagttaagggattataaatacaccaatcagcagcctgtgtctagctcagggtttgtgaatgcaccagtggacactctgtatctagctattctggtggggccttggagaacctttatgtctagctcagggattgtaaatacaccaatcggcactctgtatctagctcaaggtttgtaaacacaccaatcagcaccctgtgtctagctcagggtttgtgaatgcaccaatcgacaccctgtatctaactactctggtggggccttggagaacctttatgtctagctcagggattgtaaatacaccaattggcactctgtgtctacctcaaggtttgtgaacacaccaatcagcactctgtgtctacctcagggtttgtgaatgcaccaatcgacactctgtatctagctactctggtggggacttggagaacctttgtgttgacactctgtatctagctaatctggtggggaggtggagaacctttgtgtctagctcagggattgtaaatgcaccaatcagcgccctgtcaaaacagaccactgggctctaccagtcagcaggatgtgggtgaggccagataagagaataaaagcaggttgtccgagccagcagtggcaacccgctcgggtccccttccacactgtggaagcttagttctttcactctttgcaataaatcttgctgctgctcactctttgggtccacactgcctttatgagctgtaacactcactgtgaaggtctatagcttcactcctgagccagcgaaaccaccaacccaccagaaggaagaaacttcgaacacatccaaacatcagaaggaacaaactccagacgcgccaccttaagagctgtaatagttaccgcgagggtccgcggcttcattcttgaagtcagtgagaccaagaacccaccaattccagacacactagcaccaactgaggatgatggcttatggatttcccaaatttaaaactgggacttctcaacagagaagctgaacacgaaagcttcaccaagccattttccttttgataagaaagtgctaattagcaccatgcattctccatagaagacttgttttcacactggtttacctacggatggagttttcatgtaaatcatgagtgacagaggggcccatcatcaatgtttaaaacggaatgtgtacatggtattgctcaacctctttgagaaatatgaccccatcatttcatattagtagtacaagtagtcatttgaaattccagtcacagcagttcctgagccacaaacatacccacaaaacacatgcttggatggcgtgtgatctcacctgcatttacacttgatcaagcctttcatattgtagacagtttatttcttcctcattccatccttgaattgttaggcctcaaagagatgaggtattatgtgatagtcatctttgttcctcagatcttagtacatttccaccaggaagcagacatttaaaagtgatcattgaataaacagagttaatggaaaataaaaataattagtctcagataacacttttcggagttaactgacatgatgtttccatatttgctgggacattttatccttctctatttgagaaaccaagagagtagacttcatcaactcaggcaggtaatcttacagccgaaagccatgagaatgctttggagattcagaagtctagatcccaagtaaaagactgtcaactcctaccacccaggaaagaaagagattccccagactggagagagaagagaaatcagattgaaaataatagcagctaagatataggtggcctctgagcaaagggtggcactggtgtccaacccacaccaagcctcagaggtgctgacaaggagtgcaggacagctggagccttgaaacagcagagacctggccccaggtagatggtaacgaagctgcaagagccagagtagaagtgtctgcgtggtcggcttcttgcttgagggcccaaggcagccttgcagagctcccagggccccagtgaggtgcaggactagctaaacactccaagcatccaagcacttagcctcatggggttgcccaagcccagtgagcatgagtaggaaggggtagaatgcatcttgggtatgaatgcagggcagtcgccagatctacagatgagccaaacagaaatggggaacaatggagacacatgaagcctggaaagcaaagaacagagatgcaacaggagagtctgaactctgaagggacaactaagtactggatagatcaagcccctgtctcctccccctagattaaatagaaccctagaaaggttggcaaaacccaaattgttagactacatttctaccaccccaatagaatggggtctcaaagttgagttatagaaaaaaaaatcttgcacaacagagataatgtagattaaacttatctacattatctacaaataacaaccatattgcctgcaatacacaaatgaagatgcaatatatctgatattagcacagttttcactggtttcataacagacatttttaaaaataagggaacaaagttccaatatgacattgcatttacacagtgttttcacgacctgaaattcaagtgcttttagacaaaatagtcttttacacagtcactgttggcagaccgccaccatgtaacttgtgttttcaaatattcaaggtaggagaaagggtcaggactcatttaggaagtctggtagaagtcaagtttgcaaaaaatgaatttacccaaatgtatagaaggcttgccctactagggtggcctatttcatgtggatgtaaatagttcatgggggatgagagctgctgggaagtaggggagtaagggatagagaagcccatttcccagatgagctgaagaaatggagagcgaaacccaagggcaagtggcacgtctgcaagtagagctcttgccagcccttagtggcagatctgggaacatggggtttgcaagactcaacacactccattcttggaggaaaccagtggctccttgggacccaaagaagattccatggcatctcgatctcagcagggaaaactgaggcccggcgcagttaggataggctctcttgttcaggactgaagaggcttccctgatgcaggcagggagttggtcagcgtctgctgaggagacaaagcctgagctatcttctggctcagagagaaagagcaggcaggaagaaaaaccagcatccagctgtgccacagatgtgcttccacctctgtcttgccctctcaccctcgcctttaatcccattttataaaaactcatactcagaggttagctgggttggaccccagtctgaccaacccacagcccaggctggccacaatgtgtgtgtgtgcttagcaggggggcagtttttggggactgcaaaaggagggtctataaagaaggacctcatctctcaccccctaggggcagcctctatgggggaggacgatggtccctgacatcatgggacagtcacgaatgagggtctgtcctgggtcaggctggtgggcaagttgatctggcctctccacaaggctggctcttgcctcccccattagtcagtagcactgctgctcgtggctctttttagtttctgccttatgaccatatttgacacactgcctccaacctaaggtccctatttattcttgggcacacgccttggtgacatgctaccactgccctccctgcccagaattgtgtttggcaagctgtggagaagcttccagaatccaaaagacccttttttttaaatatactttaagttttagggtacatgtgcacaatgtgcaggtttgtttgaatggagacaattagtttaaagcaggcacgcgtaaaaccggaggcagcacttaaataaggcacaaacatgcctttaaatgttgttttaaagtcaacctttactttcatcctcaacgacttaattgacagaaacaacaagtgtatctgccaatatgtgggccggctcagtgacccatccactgagaagtagaaagcatatcatgttttgagttacagtttattgagcattaagctttcttcctgttttttctcacttttcagagtgatatccacagatattttcctataactgtgtgtaacatgactgtgcccaacgttagactggtggaatggtagataaagggggcaagaattcacaaaagggaagtcctgggaaaggaaattgagagtttataaatatatgaatgccagctcatttttattttttaaatactctgtacaacacaccaacataaaatcataggatatagtggtgattgcattcttatgcatatatctttgggtattaattttacgaaagatataaagatgattttgatgcagatggattccacatgttactgagaacatgaaaaggaggatcagacggaagcaagagaaaaattccaccttaggctctttcttgaaaggtgcagtttctccaccattgacatctccttagacctcacagtgaactggcaagtaggtccagggaagagatttctatagtatcttggctttgagtaaaagaaaatggacccaaaagcctcatcttcacaagacaaccttttggaaatagatagaaggcttgataccaaatgtgcttgaggtgtagctccaaagcagcaaataaaggcgctgccacacctgtgcaggtgccacacccgtgcaggtaccatccagtgggggcctggggcatcgcatgtcccagagcacccaggcacagggaggctgctcagcagtaggatgtgtggcttttgaggactcaaagacacttagggggtctctgcttctgcatttccaagaggacagatagctggggcaggtgcaccaccccactgagacaccagggcatgaagagtggcatgatatggtttggctgtgtccccacccaaatctcatttatactgtagctcccataattcccacgtgttgtaggagggacccagtgggaggtaattgaatcatggggcagttcccccatactgtcatcatggtagtgaataagtcccattagatctgatagttttataaggcatttcccttttctcttggctctcattctctcttgtctgctgccatttaagggatgccattgtgaggcctctccagcctcatggaactttgagtctgttaaacttctttttctttataaatcacccagtttcaggtatgcctttatcagcagtgtgaaaacagactaatacatagcacataggtggactgaaatccgctgtcccccatgagtgtgtaccgacaggtatgccctccaccagctgagcacaccagcacccacctcccctccctgacctgctcgcagccagcccacgcccaagccctgctgacattcatctcctttatctcttagcctgacaactcccctccttccccaccacactccactcaaagcaacgtcatctatcacctgaacctcctcactgactgctctgcctccactcctgcctccctcccaccggcatctgtccccaagctgcatccagactccagggaacacaaactcagccgcggcacccccttcgctgcctcctcctcgtgtcttctgttgccctcgtggtagggactgacatcctgatatggcccatgaggccccctggagtctgcccccacccagcggcttcctcaccatcacaacggattcccctctctgagcttctcctaggtggccatccgcccatgcctccaacattctactctcccttcttccaccaggcatttgcacacctgcagtttcctctttctgaaatattccttcagcactccttacttaataaattgctactcatctttcaaatacagccaacttcccattcttctggaaagtattcctggatccctggaaaggccacagttcccatgttgtactccatgtgtgtctttttgcagcacttacatgatttccattttacctgtggttgtgtcactttttgataactagctgtccttcctactagaccagaagcttctggtgggcaggacatgtctgcttttacaaatcatggtaaccatggtacttagtttagttgttgacatgtagccagcactttcttattcatttgctagttatggttaacgctgtgctaaactctggagtttaaacaatgaaccaggcaggcaaggccttgccttcatggtgtttttattttattgcaagagagatacaaacacaatagagattatgatgtttacaatgtttaaaaataaggactgctatgatagagaataatggcaagatacatggagtcatcagcaaagacctcctgaagcaagtgacatgaaaacagagatccaactggtgggaaagaacgagatttgcccaaaccagggaggaatattcccaacactggaagcagcaagagccaaggccctgaagcaaggacgagggcagcctttagtaatgtgtccagaaggcccgagttcttggagcagagcattgaaggaaatagtggttgataatacaactggaaagatgtgcagcgaccagcagaagaggaagagtttggatgttattctgagtgaatgggggagtcattgaggggactaaggcagaagaataaccacacctcgtttacatataaggctctccaggtgggctttatggagaaaggattgcacagagggtggcttggatagggcagagccatggacaaggggaagatggaaggagatctgtcccagaggcatagacaggaggccagggtgtccttaggaattctggcttccatagcagggtggatggtggctcatttactgaggtggagaagactattgaagaatgcatgggttgatggatgaataaacaaacaagcaaatatgtagagataaatagtacaataaaggagactgggccttcagggtgagatatattcataaggcaaaaaagcttccatatcggtcagggttctgctgagaaagagaaccaatgggatatgtatataaagagatttattttaaggaagtagctcacatgatcatagagggtagcaagttgatatttgcagggcagcccacaggctggaaactcagacaggagcggatattgcaatcttgaggaagaattattttcttcccagggaaaccttgtatttttttctcttaaagctttcaactgattaaatgaggcccacacatattattcatgataatctcctttacttacagtcacctgattatagatcttaaacacatctgcaagatgcccttcacagcaacacctagatttgtgtttgattaaataactgggtactataccttggatacattgacacataaaaataacaatcacaactctaaatgattgttccgtggaaaccactaggctttaccaataatataactcagaggtcagcaaactatggtccatgggccaaattttgccttccatctgtttttgtgaataaagttttattggaacacagccatgccaactcatttgtgcattgtctatggctgcctttgtgtaacagccacagaggtgagcagttaggacagagaccaaacagcccgcaaagcataacgtatttactatctggccctttacaggaaaactttgttgagccctggtgtcacttcattttgtggaattactcaggcaaagtgactgctgctaggcaatagtcaaagtcaaaatggttaatgggtctgaaaccagtggagatctgggaaaattttaaaagaatagtcaaacatgacaagaggtatcactggggaaaagaaacccaaaacattagcatttggcttccaagcagctcacattctggccttagacaactgttacctcactgctcagaaatggaagcttgaagctcgtgtggaaaaccgacctcctaataaatctcacacagaggatgcagcaatttgttatgcgtgagaaaatggcactgggaaagcaaaacacagccagcttgcttcatatcacaagtagcaattgggctcaggttttcacctaatttttaagcagcttatcaccacctccgaaaagaaaaaaaaaattctaaaaattgcattgcttttttttttctgagaagagcatattatgaagtgtaaacattaagaaagtcatttcccaatataactatttccaagctttgtctaccacttgtgctatcatccaaatgttggtgtccccttctccctgaaaatttggatgttggaacctaatctttagtgggatactagtaggaggtgaggcctttggggaggtgattaagtcatgaggtcagaaccctcatgaataggattagtgcctttgtaaaagacatgtgagagagcctgtttgccccttctgctatgtgaggacaccatgagaataatctgcaggagatgcaagaagcagaggcccttcactagacatggcatctgctggcaccttgatatcagacttcacagcctccagaactgtgagaaatagatgtctgttgctaataaattacccaacctaaggtattttattatagcagcccaaactgactaacacaactcactacctttaaatatttttgtccaatcaatacagctccctctcccttttttggggaataaaaccttgctgaaatgaacggactctaatatcttgatttattaacccacatctgagccaaaatgatgtttgtttgagaatctacttagtactgactgaaagaaactgtacaagaggtttttttgccaatgtgtgagaaaatagatcagagataagattaatctttacaaaagacaaaaagcttacaatgctttgccaaataaaattaactttcataatttgcctactatgtatttactatgctatgctatctgtttagcatacaaaccccctacaatccctacagtaatcctagatggtgcctacgttttaatctcaggtttatagatgagaaactaagacaacctggacttaaagccaggccaccttactccacaggccacaccccccaccacggtgaacactacagctgtgataagacaacagaaaattgcttatccaaaataataaattatatatttatattccccttgactcacctgaatagtgttcatttttatttagaaatgtaactgtattcgtttgttctcatactgctatgaagaactacctgagactgagtaatttatgaagaaaagaggtttaattgattcacaattctgtaggctgtacaggaagcattgctagggaggcctcaggaaacttacagtcgtggcagtaggcaaaggggaagcaggcgcgtcttcacgtggtgacaggagagagcgagcaagggggaagtgccacacacttttaaatgaccagatctcctaagaattcactcactatcatgagaactggaaggcggaagtctgtccctgtgattcaatcacctcccaccaggcccctccaacactggagattacaattcaacgtgagatttgggtgaggacacagagccaaattctaacatcttgatttactaacctacatctgagccaaaataatgcttgtttgagaatctactttaagtaacaactgaaaaaaatttatgagttttttattgccaatgcgtgagagaatatatcacatactgacaagataaaataagattaatatttacaaaaggcaaaaagctcacgatgctttgtcaaataaaattgataatttccctaccatgtatttactatgctatgctgtgtatcaaacaaaaccccctacaatccctacagtaatcctagatggtgccttcattttaacctcaggtttatagaagagaaactaagacaacctggacttaaagccaggccaccttactccacaggccacaccccccaccatggtgaaaactacagttgcgatgttaagataacagaaaactgctattcataatagtaaattatatacttacatccctcgactcatctgaatagtgttcatgtttatttaggaatgtaactttttaaagaatgcaaagttttatttaagaacctgcaaagttacctcatataacagcaatattcctgccattatgctgcatatggagatagaaacctataacaatcatctttccctctaacttgcttccaccttctccagtgggtgacagaaaagacagataggacctgtacatccagctttctctgctaccccttgaaaaagctccatctattccaatcagtgggcatgcagcttcctggttttcttacacttgctgttactcatagagtatctcgtgctgttgtttgcatttttactagtttcagcttattttagggtttcacttaacgcacagctttgtacggaaagtcatagattccactgctcctctcagtgttttacacaggttttactgaaacccaaacccctgcctagcatccctctttttcttcctcacttcccatggcaaagtcagaatttattcttgagatttcaatcttctcagccttttagctttcctggctgtgggaccgcagaaagctagcactgcagctatggtctagcaggacagcgtcccagccttattccctctgcacttaccatttctgtgaacactggctcagtgtccaaccacaagccccatctgctctcttgtgaagtggaccagaagtgtccaggattaatgctgcttaggctgagagtaggtggatcaacatcccagctccctcacccttcctgtagatgacatttcagtttcatgttctacactttctcccagagtttctcaatggcaccattctccagttggccacggtggtaaattgcttggtgatgcattttgtatctctgttgtgccttgcaaaacccacttcctaattgctgtttcttgggatggcctcccaaataaagtacttgtgtttgacatcttatctcaggtcctgctggggaatccaaattaagtcagcatgctgtataacataccccatctcccctctctataaggacatttcttttagactatctcttatttcagtcctgagctccaccttgtcaagtattctggatacccatgagggcttagcaaaagggcctatgtctgtcaccctggatgggaactagccacttcaggaaagctctgtgatagccatgtgtaaggtcatagttagaaatgcccccaccctttctcattaagttctccctacccttattcacatttggcactttatttaactcttcccattcatatattttgagacttaggctgaatttagcaactttacatcttctaccctttctcattgtgctaaagtctccatcagggtcatgcaaatggggaaataaaggttgagcaaatggggaaatattattctccatatggattgtgaaagtgtgcaacctataccactgtcagcagcagctctggtcttcatcctgccccattgttttctgaaggtgcacaatccagcctcctactagaagaacccagactcttgtttccccattcacaatgggggtgttcacttacacattaggtcaacatagttgcaggaggttctagaatctagccactttggctctatcacttattagctgagtgaccttggacaagttatttaacttcccaccagctcagtttctcatctggaaattgagaacaatttcaattataacaatgtcataaaatctttgtgtcaggtgaaatcatgcatgctgagtgctttgacagcacccagcattttgcgggtttttgacagatgtcagtcaccaccgactctctgtcttccccttctgcaggtccagcctccagggcgatgacaagggtgagagagaaatatgagcccagcctgccaggtcaggaacaaggagagcgaggagctgcctttccttttccctggctccttccaagtggcagtgtggacaaacagaacaggcaagatgctgtggatgtggagctgaatgattcatcatgcacatcaatttaaccagagtcagttagcagtatcccaaagctctgaaggacaggggctcaattaaccttttaatacacaagtcaaatttcttgtcttcatgacttacttctttaccagcaaaaagcctccaaaacccttctcagatctttgtccaaggtgaggctaaactctgtcactggtggggcttcctctaattccctgtgttgttctgtctgctgtgatgttatcactctaagagggagggtgcattttgaggatgacagagaaggacacgtatgatgcagtgttaacgcagacctttctctccacctggatgaagaactacgttctctggccgccctcatacttgtcgttaaaagaacgtaaattatttcacaattctctcccctcaaacacacccactatttctctttcttcctgcaagagctgagtttttttctcttcaggataaactagcacattcttttaattcccaggaaattatacttttccagggatgattaccacccattctcagagtttataagtccaagggtaaggccctgatccaattggggctggagctacagatgagaatgaaaatgacagaccatctctgtgtgctcctggactgtgagaggtaaaatttggaatctgacagctgtcacgtttcctgataaatgaaccagagaagtggagggagaagggaggcctgggaaaaaggcgctcctcctaggcttcaagtcctgaagccaaagcacattctttactttgagtcccaaaaggcaactcattattattccaataacaccacctttgtttagtctgataggggtacggtttctgtcactagccaacctagcgatgattattacattatttaaattaaacacccatttctatttttgggaggccctcgtgggtgatcaacctgctgatttatgaaccaattcatgctacggtagtgatggggaatagcagttaccacactatcttttgttataccaactttgccttgacacccaatgtttaatgtcttgacctaaagtaatgactaataaaccccaatgccagcaaagaggaagcccacagagaaccagcatcagtgcagatgagtctcaaggcaacacccaaatatcccactaggcctctctcttcctgcatacacatatgttaaggcttgaatttaatttttttctcacactataaagctaagctgtgtcagtaatccccatgccaacctgctggagaaaaagtcaatctaacatcattacatttttctggctattttaattcagttaaaaaaataaaaataaaaaaccacattttccctagtacctgcctatttctagaaaaagctaactggaaatcagaaacaaagaagacagcctttaactgctttattaatgggagcttggtcatgtcatttccaagttcttctttttccaaaagacccaactgatagtcccgtattcataaggcacctgctccctcacccctacaagttcaaatccagttttctttcccttttggagcttttcctggtgaaattatagcttctcatagtgaaggtgaacagcgtgctggcttatctggtccctccgtcaccttccccacccctcatctgccctctgcaggtcagggtgtcaacagtctccaggacaggtgttaactaacctacccctggaggcactatgtgttgggcagtgagaaacccaaactacattccagactcactcatttgaaaatggaattaataaaactgggaattaatgaataacaatattttagaaggagtcacaattgcaagatgccctgctaacccagcatccaaaaaactgctgtttactctgtcatctttggcaatacacaccattattacatcttagttgcttaatccgtaagaggcaggtaagatgccaagcaattccttggagttatggtaagttattcatgcaaacactatatttattaagtgattcaagcataaaggtcattcaacgcttacgctctctttctaatgcccttctgatgctccttcttttaaagcctggtggcaaaagcactcccaactcagaacacaggagtacaacttgaattcagagaatttaagatgatctctaaatcaggatgagtcttacaatccaagctatgtcttagaattacataaaataatggtgcattttatataatcagtggcattttagatttgatgaaatacagcaactgaattagtcctcccagaattcaaggtctttttaaagcaggatttaattcatatctcagtagctttccccaaaattttcagcaattgcaccctgcccacctattcatgaagctgagagggatcacaggagttgtctagtcccaagtccccagagatgttttctggtgatagactgtaaccaaaacgacctctggtatttattaagtttgcaaaatcttgtgtcaaagttttctcagagccttttatatgctaattgaaattatggatttgtccgaaaggtgttctagactttagaatttccctcacttatttgaccattaaaccttttatcctaggactgatttgtaggcgaataaaaatgctgaaaaaaagtgagaccttgaaagattacacaacctgcccccaaagacccagttaataagtggtacagtaaagaatgcagtctggcttttcttattctgcttctgattctcctaccacacagcactgcttcatggatcagttttcaatgaaatgaataaaaggcaccatggtgtagttctctcttcactcacgcacttccctcagaatttcaaagccaacgagttaacaaaaagacaaatttacactggaaatcaacaaccatctaagctgtggaattttttagtgcattgtgatgtccattaaaatctgtcacccaattgccttccaaaaccccagagcaactgaaacacacaagcgtttttgagtgggcaggggttaaggggcagaagccaagagaggatcagagacatctcccagtaacacaggggcccatttccctgaacctgtcaaaacctttgagcaggtaacaccgaggagtgggtctcctgtggctggctttgcaactccttctcttccgattatgaaaatatccttcttacactgcaccgtaatcatttgaatttttattgttttcactcaaaagctcctaagttatttagataagcaccattaaacaaaaatctgagtaattagttcttttgatgtgtcctagtggcagtggaggaacttgaagacgtttattaactgttagatcagtcccaggtgggacttattataaacagagcttagccccagagcagccgctcattaaatactgaacaggaattaggtatttctctcttcccatgccattcttcatcaaccagcctctaccacttgggtaggattattatattatatattttatgccactaaataccacaaatcattgcttacgtgaagtcccggaggtggggctagaacacaatcacaccctcctttagagactgcgacccagagagaacaatcagaagggactcccagagatccgctatttaatcctctcatttggctggtcagagacagagatccaaagaaattaagagattttctcaaggccaacagctggtcaatgggacccgcttctcccatctcttgctttagtaaattttccatgccaagacattttcaagtgcttgacagtcacccacggatgctgactgctctgagtgatctatggcaaaccacccactcttttcccagaatgataaatgtttcttatgtctaatgttgatataaaatgttatgaaaacgagaaaatttgggggatcttagaaaataaaagaaagatttacatgaaataaaaatgagtggttttatctcgtgtatgttggaaaacagaatagaagttgattggcatccatggcagaaggggatctgggttctcacttgttcccacctgttcaagcatcccagtggagtcctcagtcctcaagtctgtaaaccaggctgaacagccccaggtgaccgggacacagtgggaagtgagtcaactaacccctaaaagctcctcccagtcccagggtcgtgccttcattcttgaaggtcggtttctctacagcataaacgtcattattcataaggctttctcccctgtgtcatgtaacatagggcagcacaaacaagactgtttttttttaatacatagatggagtttcgctcttgttgcccaggctgcagtgcaatggcacaatctcggctcaccacaacctctgcctcctggggtcaagagattctcctgcctcagcctcccgaatatctgggattacacgcatgcaccactacgcctgactaattttgtatttttagtagagatgggtttctccatgctggtctcaaactcctgacctcaggtgatctgcccgcctcagcctcccaaagagctgggattacagacgtgagccaccacgtctggcctgcacaaacaagattttaaatatgttttcctgttactctccgagtgttttgctaacagatgatttgcaaagaatatacatagaaagacagctctcattcacccactgagaatcagcctcctgaaaactttaggcagactcaataaaaataaacttatcactacatccctgctcctaagttccatgcagaacacacatcaggagtctgtagcaaaatacctctactcccctgagagatttgtacatgctaatctcaatgtccctaacatagcatttaacagcttcaccagccacatggaaacagaagaaacaccaagtttttgtggggaaaacatttcaaaaggacaaaatatctttgaacctgactctaccttactatcatttctcatttttatgtcttatttaagatctgtgaaaaacaatccaaggtttagtgctgattttcttaacaaaagaaaatactcaaggttgttttcataaatagacaatcttaactcaattttcttctgttaccacatgccacatttaaataacctcaatggccaggaaaacttaaaaagggaactttcatgagttaggtagggcttggctgcatctaattcaatgtcattcacaagaaaagctaaaaatctttacctgcctgaagttcttaatggaaggggaggaagaaacccaaaagataaatgaacaatgcatgtctaaattaaaactgaaccaaaaaaaaagacatcagtcagagaaacagtcagagaaacagagagaaaagtagcaactttaagcatgatgaataactgatccacatccttagcaaaaacaagatctcatcaggaaccaatcaggagcaccaacctgaatttgctgattcatggaaagcaataggtgattaaaaaaaaaaaagcctgagcctctttcttttccatttccccaaccagacaacctgcgaagacactacacacttatgatacattccagattaactttaccaaccaactctcttggactttactgttaattagtgcagaggcaactcccttttttctcttctgcctcccaggcttcccctctggatgctaatgaaatagggagatttctaagtttcattgtctcagttgagcagtgctattctttttttttttaattttattattattatactttaacttttagggtacatgtgcacaacgtgcaggtttgttacatatgtatacatgtgccatgttggtgtgctgcacccattaacttgtgattcagcattaggtatatctcctaatgctatcttttctacaggcaatatggaaaaaataaacatggaagatttctggatggaaacagtttacaatcaaacatcccattgttgacaaaatcatcataattgtcacttcgcgcctctttgccaactgtataattagtgtcattaccagtaagtcatggaaatataaatgatagtggattatacaacccaaaactgcataaacatgaatattttatggtacctaagcaatgtcacgaattgtacataacatagacttggcatttgcttccagcagatcttaagatttctcacccagactaagtgcacagtcttaccatatagctttagaaagatgtttctggatggatgttaccaaaggcaagtgaggaggaggaggagaggagggaaaaaattctctttggaaatgatttttaaaaacacaattattagtgtatttttatgtttaggacatgaaattccatttttatattttcctacatggaatataatttcaaaagaaaatatttttaaaataacaatttaaagccaaatgtattcaattttgtattgcctactatccgatcactcatgtttggatactttggcaaatatgttagaccagatcactctgcacccaagttgcctatactctccctgactggggtgatctcttcctttcccctctgcccaagaccagctcaagacacactgctctctcccttctttgaatttctaaaggccagactctggaaaacataggttttgacatttttaagactctgtaaattatggcaatcaaactctttttgtttgtgtatacatttggaattgccatacttctacaagcactcccgtttttagtgtctaatattgggccggtgggtcataggtactctgtcaatatgtaaggaaaattattaagtggacacgttcattagtttttatggaaaataagatgggaatggaaaaatattggataaaacccaactattcttttcaacagaattagatcacaccctggtaatcaaaagcatccatacagcaacaagtggtccgtgtggtccttaaaacatgccagtaggggttgagaaataccctcctaatcaaggtgattattcatgacaaacttgtatatatagtaagggccaggtgagtctttcatgacatcattagattatcagatctttgaggaaacagagtggtgtctggtttgtttatagctgtggtgggcaaaacaatggcccccaaagacatccacatcctaatccctggaactggtgactatgtgaggttataccaagcaaaaacaaagcacaaagtgttcttttttctttattcttaacctagaaaatgtttatcatatttaaattttccattttgactcagttactgtgctttctgaacatgtatacaatgttatggtgaagtttcagaaaatctttgaaatctgcagctgcattagacaaagagtataaatgtacctgttcaaagtttaaaacataaatttctgtttgaaaaacgaagatggactgataggttgaaacttcatcttacaaggtttatagtgacacaaagcagttgacacaatgacatttctgcttgaggaaacttactgtgggtacattgaagagaatgaattggtggaaaaaggctgcgggcagaccaagtaagaagttgttacattaaccccagcaagggatgcagtggcctggcctcatggcagtggggctaggcaaaagtagatgaattctaggaaaggttaggaggtaatattgacaggagttggcaactggaggaaaaagagggagaagtcaatgggatctggaccacatggtgaaagacaaccgttcagtaaggagcagagcatgagatattatggttgagtatgaaatttattatggttggacataatataataagttgaagggagagatttttttaagaaacatatatttggaagtcattaatatatgaatacaaatggaggtcactgagtatgaaaacacccagggtagcatagccaagacaatactaggcaaaaagaacaaagctggagtcatcacactacctgacttcaaactatactacaagcctacagtaaccaaaacagcatggtactggtaccaaaacagatacacagaccaatagaacagaagagagacctcagaaataacaccacacatctacaaccatctgaccttcaacaaacctgacaaaaacaagcaaagaggaaaggattctctatttaataaatggtgctgggaaaactggctagccataagcagaaaacagaaactggaccctttccttataccttatacaaaaattaattcaaggtagatttaagacttaaatgtaaaacccaaaaccataaaaaccctagaaaaaagctaggcaatatcattcaggacataggcatgggcaaacacttcatgactaaaacaccaaaagcaattgcaacaaaagccgaaattgacaaatgggatctaatcaaactaaagaacttctgcacagcaaaagaaactatcatcagaatgaacaggcaacctaaagaatgggagaaaatttttgcaatctacccatctgacaaagggctactatccagaatctacaaggaacttaaacaaattttcaagaaaaaaaaccaaccccatcgaaaagtaggcaaagcatatgaacagatacttctcaaaagaagacatgtatgtggccaacaaacatatgaaaaaaaggtcatcatcactggtcattcaagagatgcaaatcaaaaccacaatgagataccatctcatgccagttagaatggcgatcattaaaaagtcaggaaacaacaggtgctggagaggatgtggagaaataggaacactattacactattgctgggaatgtaaattagttcaaccattgtggaagacagtgtagtgattcctcaaggatctagaaccagaaatatcatttgacccagcaatcccattactggatatatacccaaaggattataaatcattctactataaagacacatgcacacatatgtttattgaaggactatttataatagcaaagacttggaatcaacccaaatgcccatcaatgatagactggataaagaaaatgtggcacatatacaccatggaatactgtgcagccataaaaaagaatgagttcatgtcctttgtagggacatagatgaagctggaagtcatcattctcagcaaactaacacagtaacagaaaaccaaacatcacacgttctcactcataagtgggaggtgaacaatgagaacacatggacacagggaggggaacatcacatacgaaggcccatcagtgggtgggaggcaaggtgagggagagcattaggacaaatacctaatgtatgtggggcttaaaacctagatgatgggttgataggtgcagcaaaccaccatggcacatgtatacctatgaaacaaacctgcaagttctgcatatgtatcccagaagttaaagtaaaataaataaaatttaaaaagaaaacacccagggtaagtgtacagattgaggacctagggaaaaacctctgaggaacatcattttcaaggaacaggacagaagacaaattgacaaaggagactaagttcatgactagatagaataaaaaccaggagaatttagtgttatgatagctaagagagaagatttccagatggtggatattaaccaagtcaaatgctgctgggaaatgaaacaagacaaaagattgggcattggagtttgcaatatggatatcattaggaacctggttgagaatattttagtgaagttttggggacagagataggcctgaagggtgttaaagaggggtgaatgtaagattgtgtctttgaggtgctatacaggaacacatgagtggggtaatttataaaggaaagaggtttatttggctcacagttctgtagaacattcaaaaagcatggcaccagcatctgtttctggtgagaaattcaggctgcttccactcaaggcagaatgggagggggaactggcatgcagagatcacatggcaagagaagaaacaagaaagaggtgaggaggtgctgggctctttttaacaaccagcttttgcaggaactaatagagcaagaagagaactcactcattaccataaggatggcaccaaattattcacaagggatacgcctccatgacccaaacacctcccattaggccccacctccaacactgagaatcaaatttcaacgtgcagcataagggacaaatattccaattataacagagcaccaggggagaaagtaggaaaaacaagtgggacacctctttcaataagtttagctaaaaaggagaacaaaaaatgagatggtaaagatttgtaacttttttttttttttgaaaagagagaaatgctaatctggagaggccagtaaagaggatgaggttgaaaattcaggtcagcatgaggataactagtgtcacaaggtacctggggagctgggatgggtctagcccagggattaggggatgtgttatggataataataaaaaacatgtcttcactgtaatgggatggagtgaggaaagaatggacatggtggctgcaggtgagattttcaatatggtggaggaaaactgaagcagtttccttctgctggctttttattcttctgttaagtaggacatgaagttttctaaatgcttgattttgaaaggagagctattctagcatttaaaccaaacttttaatacaaataaatccaagattttcatgtggtaccatctctgcataggtctaaatttttatttatttatttatttgagacggagtcttgctctgtcacccaggctggagtgcagtggcacaatcgcggctcactgcaggtctaaatttataagaccataatctaatggtttaaaacaatttaaaaagaggttgcaatgttatttgatgctcaactttataaaagagcttgtcttagtctatttactgtagctataacagaatttctgagatggggtagttgataaataaaagaggtttatttggctcatgattctggtgactggagagttcaagattgggtagctatatctcatggagccctcaggcgctttcactcatggtggaaggtggaaggggagctggtgtgtgcagagatcacatgccatgagagtaagcaagagaaagagggagggagatagtaggcttttttcagcaaccagctctcaagggaatgaataaagcaagaactcattcaccccagaggaagggcattaatctattcatgaggagtctgcctctatgacccaaatacatcccattaggcctcacttccaacactggggataaaatttcaacatgaagtttggaggggacaaatatccaaaccatagcagagctcattcataatacacaaaaagaattctcaaccccctttgactcctctacaaatctctcacttctgtagcttctcaagagcctcccaaacaccaaaaatacccctccatacccagccagggccaactttcctttctctcttctcattctttgccttctagctctctattatgaaaataaactgaaggcttttagctaaatctttttctctttcttcttatttttagacttctcccccttctatccattttccagatttaaagttttccatcacagtagatccagcaacaggtctggaaaatacagaattttactcagaagactctaataggaatataaaatgaatgaacataggggaagaactcacacatgattaagtcaaggcacagccctctcatcagtaagacacaagctaccctcgtagaatgtgatgtcaaagttggagaatggcctagcatagccatcaccatttgtgtagaccttaaatgctgagggctgccccctcccaaaagaacagaggttaagtggataaaaaagagtgatcaataactccgaaaaattgaccatggcatagtgatgtagctgatactggacaaaatttgaattattgatcatgtacagcatctgtacatttaaggcattaattcttcagatactgaaagattctaaaaggaatgaacaggaatgttaaccacaggacttattggagactataggttaggctgagccaggaacaaaatccctctatgcattaataaacttagtaaacccacagggaatgtgggagatgctttccactcttccatgtagctgttgaagggctcattacctgtgcacacaaacaagagaaaaatcaaaattcctctcccataaagcgatacttcaaagaaattgtcttataagtcaagtacaaagaacaacaaaatcacactggattaacacaacaaaactgatttcctgctcatgcaaagttatttgtggatccagcaaccttggagaacaggtgtcctccaaggcaatgtctcagcctcctaggctgctgtgaacctctcttttctctgactcaacatgcatccatatggccactaaggggaaaagagtactggagagtttccatgctggacatacccctttgcctcttgagaggccctcaccagcattcttcaccctgattttggttgcaggaggcagatctgtttggaatgcataaatgagctatcttgtcttctggcttctcattcgatttgaccaataggatgcaccagcaggagatccaagggcagaaactgggtgagtttagggcgttattcctccactcacttcctgtgaaatcacagtggcctggctgcacccctctacggaggaccagcacttgctcacatactgtctgcctccctatctcttccactctctgcattcttgtacttgctcccttcccttgccttttcaagcttaggtgctgtaagacctccccagagtacaccaccatcctgctgctttcttaaaacatagcccacacctttgcaaacttaaactccagcctagtccctttagtaaactcttccattactcagattttaaatgatttgctctgaacgtggcccacatcacttccacttgaaatcatcgaccagaattagttacattccttgcttaactttaacaggaatgggaagtttaatcctctcaattacccaagagaaaggagaaccagatattggcgaaaactagaagtctactgctgagacctagcaatagacataatgtgatttacatgataattatagagaagcaggtcactttctcactttcatcattagaaacagcacataactcatcacaatcccttttcagtgtgcttccaaacagttggagcacttccaaaagcagtgatcaagtacaaaattaccaaatcaatcctcaaattggcaatcagattgaaataactgtttcctctcaggttaaagaagattaaccattagctctttagaagaataagcagggcagtcacagactttatgcaatattgattggatgtatcctcacatacaaatgccatagagtagctctcagggagctattacacaactgtctcaggagaggcagagataccatgttatacttcaatacgtatatgatgattgattaaaacaaccagaggtaggtgtaatactagctactggccagcccagaaatgaccagggcatgcagaataagaatagactggagtcaggagctggatgtctttggccacatcttttagtctggttccttaaatataaactaaggcaactagatcaaaggttttttatctgtgataaatggatctatctcattagatctgctaaaatgttacaaaattggaaatatatttgcttgtgtggttttctaatggaaaatattcacaggtttcataagacctacagaaatatcctataaccctcccccacccccaccaaaagaggttagaaccacagggctggatgatgtcacacactgcttccaaatccaacattttataattctatggtcacttctggtcaatatattggtctgatgaaaagaccatataatatattctcatgaaactaaaactttcccagtatagagacagcagacaggtaatgctcaatagaggtatgtaaatctgaatctgtatttatttttcctaatttttgaaaatgtcatctgtaaaaggtcagagaaacatctgttataaatgattccttctgttttctttttattatttaccccaaaataaggattcccacacttgctttacatttcatatttgttttactctcagtgactctatataaagtaagaggtatacaagagtttcctccaaatgagattacatgactattcaactttgaaacaagatcctgaaatacctatttaaataaccagtaattgttatgcacaaaatcttctccaaagaacaaactttaaaatggttattagcaactcttaatggaccaaattttctaactcaatgtcctaaggtacctaaaccacctgctctcagctttattgtcctgttgctttaattaaccataggttcagtttaacttgcattctaattgggtccttgactaattgtgcattaaatacttggtagcacaatacagataagtaactatcaactttcatttgaacatagaaagcaatctgggaaggcttaggatgtcattagactgtagttgatggtttcccgtggaaacaaaggagaaggaaaagattaaaatgactcaaaagcatgatcgatacccacaggcatacatcagagatcagaaatctttaaaataaagttttgtgttaagttagatacactacccattctggcattttcaaagtgtatttagggtgaggctgaattcaactccaggattcaggagaggttgaatgtgcagattcttataagaacttgtgagtatatgtcctggtattcactgtcttgtcagccaatgttagcttttggcaatggcagaaaataactgagtcctctgtactccagggtccatgtagctctactgaaaacttgtttcttctttacatgctcttctttccactctggctttcctaacacctaaatgtctgatatccctctttctccaacaattacttaaatattggtgctatctggccgtctagcctgaggcccctcacattgtttttatgcatgaatgaagaactcccacttacgaattcttagcaaatatatcattttttttatactttaagttttagggtacatgtgcacaacatgcaggtttgttacatatgtgtacatgtgccatgttagtgtgctgcacccattaactcgtcatttaacattaggtatatctcctaatgctatccctccccttccccccaccccacaataggccccggtgtgtgatgttcccctttctgtggccacgtgttctcattgctcaattcccacctatgagtgagaacatgcggtgtttagttttttctccttgtgatagtttgctgagactgatggtttccagcttcatccatgtccctacaaaggacatgaactcatcctttttcatggctgcatagtattccatagtgtatatgtgccacattttcttaatccagtctatcactgttggacatttggcttggttccaagtctttgctattgtgaatagtgccgcaataaacatacgtgtgcatgtgtctttatagcagcatgatttataatcctttgggtatatacccagtaatgggatggctgggtcaaatggtatttctagttctagatccctgaagaatcgccacactgacttccacaatggttgaactagtttatagtcccaccaacagtgtaaaattgttcctatttctccacatcctctccagcaccggttgtttcctgacattttaatgatcaccattctaactggtttgagatggtatctcattgtggttttgatttgcatttctctgatggccagtgatgataagcattttttcatgtgtcttttggctgcataaatgtcttcttttgagaagcatctgttcatatcctttgcccactttttgatggggttgtttgtttttttcttgtaaatttttgagttcattgtagattctggatattagccctttgtcagatgagtagattgcaaaaattttctcccattctgtaggttgcctgttcactctgatggtggtttcttttgctgtgcagaagctctttagtttaattagatcccatttgtcaattttggcttttgttgccattgcttttggtgttttagacatgaagtccttgcccatgcctatgtcctgaatggtattgcctaggttttcttctagggtttttatggtttcaggtctaacatttaagtcttcaatccatcttgaattaatttttgtataaggtgtaaggaagggatccagtttcagctttctacatatggctagccagttttcccagcaccatttattaaatagggaatcgtttctccatttcttgtttttgtcatgtttgtcaaagatcagatggttgtagatatgcggcattatttctgagggctctgttctgttccattggtctatatatctgttttggtaccagtaccatgctgttttggtcactgtagccttgtagtatagtttgaagtcaggtagcatgatgaacatcagtgtgaaaatcctcaataaaatactggcaaaccaaatccagcagcacatcaaaaagcttatccaccatgatcaagtgggcttcatccctgggatgcaaggctggttcaatatatgcaaatcaataaacgtaatccagcatataaacagaaccaaaaacaaaaaccatatgattatctcaatagatgcagaaaaggcctttgacaaaattcaacaacccttcatgctaaaaactctcaataaattaggtattgatgggacgtatctcaaaataataagagctatctatgacaaacccacagccaatatcatactgaatgggcaaaaactggaagcattccctttgaaaactggcacaagacagggatgccctctctcaccactcctattcaacatagtcttggaagttctggccagggcaatcaggcaggagaaggaaatattcaattaggaaaagaggaagtcaaattgtccctgtttgcagacgacatgattgtatacctagaaaaccccatcgtcttagcccaaagtctccttaagctgataggcaacttcagcaaagtctcaggatacaaaatcaatgtgcaaaaatcacaagcattcttatacatcaataacagagagccaaatcacgagtgaactcccattcacagttgcttcaaagagaataaaataccttggaatccaacttaggagggatgtgaaggacctcttcaaggagagctacaaaccactgctcaatgaaataaaagaggatacaaacaaatggaagaacattccacgctcatgggtaggaagaattaacatcgtgaaaatggccatactgcccaaggtaatttatagattcaatgccatccccatcaagctaccaatgactttcttcacagaattggaaaaaactactttaaagttcatatggaaccaaaaaagagcccgcattgccaagtcaatcctaagccaaaagaacaaagctggaggtaaagatatcatttataaaatcttgtctaacatagatagtcttcctctaatttccatttcaggttttaaaaatttttgataagacaagggattagtcagatgggttaattccataatttacggttcattagcccaattcggtataccctcaaaactttcagcctaagaagagtcctagagatcctgcctcagactggggatatagctttgttaccagaaaagagtcccgatccagactccgagagagtagtacttggatactgcaaaagaaagaatttagggcgagttcatacagtaaagtgaaagcaactttattaagaaagtaaagaaagaaataggccaggcatggtggctcacgcctgtaatcccagcactttgggaggctgaggcaggtggattgcctgagctcaggagtttgggaccagcctgggcaacatggtgaaacctgtctctactaaaatacaaaaaattagccaggcgtggtagcgtgcgcctgtaatcccagctactcgggaggctgaggcgggagaattgcttgattccaggaggtggagcttgcagtgagccaagatcgtgccatggcattccagcctgggcgacagagtgagactccatctccaaaaaaaaaaaaaaaaaagaaaaacagaaagtaaaggaataaagaatggctattccattgacagagcagccccgcagactgctggttgtccgtttttatagttatttcttgattacatgctaaacaaggggtgaattattcatgagttttccagaaaggcatgggcaatttcccagaactgagggtttctcctgattttagaccacataaggtaactttctgacattgctatggcatgtgtacactgtcatggcactggtgggagtgtagcagtgaggacagtcagaggtgactctcatagccatcttggttttggtgggttttagccagcttctttactgcaagttgctttatcagcaatgtctttatgacctgtattttgttctcctacctcagcctgtgacttagaatgcctaaccatctgggaatgcagaccagtagatctcagctttattctacccagccccaatttaaaatggagttgctctggttcaaatgcctctgacagtttggcagcatctaaatgacatcagtttggaagtttgtaccccaagagtctacacgagggagcataaagtagttcaaagtgcctgctataatcctttccatgagatctaagagtaaagcctaaattgctggcctgtaccttacgcgagagccttcagggaagcatcagagtaaaacaaaaattatctggagatgacaaagacttatggttgtggtcaatttattactgtaattaatatcagaatgcaggaggatacaattcccattagagtatagagaataattatttcataagggtttgatcaatgtctcccaagagtaaggcaaatccccagaatcttcttataagaaatatactttctgaaatactcatgttcatattcataacattgtacctctacaaactcaagaggaggttaagcatctcttctaatttgacagcttttcccatggggctcttgcaatactgttgggctaatttaagaaatacatagcacataaaacaaaattttttttatgtttgtcttttcatacagtaagaaagtaaatctttgtgagtggttgggggcctttgggaaatttcaaaggtatttttcggtgtaaaagatatcatgacatttttattttattttttctaaatataggagctgatctttgcaaggcaaagtcgaaagggttgtcaggagatttggggcacttgattttgattagatcataagcacctgagaaacaactgcatggtgatctgtttaatcaatgtgacaagaaaatattttgaaataaacataaaagataatatgctcataaagaaccttagttctttcacatgtgagaaaagtttgttctctggatttttcttcaacaatcaaggacataataaagtcaaaataaagcacacacataaagcacagaaaatggttctggtaggcacaggttctctgctccccagacagatttcagagaagttaaagaataatctttcattctgtaaacgaaggcattaatcatcaaaccaaggaaataaacccatcaaaaatgaaccaacatttaagattttaatttactttatgccttcttttcagatttagttattaaaaaccaaggcaaataaaattcattttccaggtctcatattttactgagctctttcatagtgtggaacaaattgacttttatattaggataaaactactctcctttttcttacaaaacaaaggcatatgcccacctgcctttctctgtcatgacctctagtatagtctcaaccacagatactgattacagtttctcatcaaggtgaatatttcctatttcacagagaaaaatagagggtatatgattgagaagtgtcattctgcagcattttagcagaatagcacggctcatgaacacatttaacacagctttggacagtcacagccaccccttttacatcttcttaaagtggcaaaaatgacatttattaacatgatatagactcttcagcatgtagaattataaaacttaaaatcatgcttagacatcaagatttcagtattctgcattacttacacaatgtctagatatctaagaattacccattaattagcttaaattaatattagttcaagactttaaattacctaaagaccttggaaattacatttaaactagcacgctgaaaaacataattaccactgatagaaaagtttgttagaaaaatgattcaatttagttgaacacaaattacttttctcataatctttaaaactctgtaggagtattattagcttattttatctcaaaacctatataattttagaaagtttaggctatttttttcatgagaaaaacaacccaagtaaaataacatgtatatacagttaatatcaataattttgaaaccatgattattaaataaattgttcccatttgccaaatatatatattaattatgtgaacctagattcttaaaagttttcaacgtagcagtttgtgtaaaaataatttttaaagtatagcacatttttaaaagtctagcacttttaaagtattagaaatttgattttactactttaaagaaactctaagaatatttgatttacttaggtatgtattcatctctataagtaattagaacaaagctcttttaactgaagaaccataacaacctaatttattaatatctcctggaaatagggaagaaatcataccagtccaatgagggattacggcctttgtcagttacgtatacacaaacacacaaacatgaaaacatatacagaatttacagcttcagttctacagcaactgccccaggtcaaaataaacatagacacatacgaactccgtggtccagatttcaaagagctgttctccttcccagaaatttttaattggttggagctcaaaatagacaaacaaaatctaaaagaacccaacaaagaactgtgtctctcacccaacagagaagagaccattattgtccacctatagagatcaacaaattgaagataatagaaccatatttccaatccttgctgcctccaaggaggaataaattagtatccgtgtgagcaagaaacaaaaacaaaacacaaaatcagggaaaaggaagaaaataaagagaaaatcaaggttaaacttctacagccacttggaacttagactgagagccaagaaaagactcccccaggcttcggcagcccatgaggtgcacttgtcccataacagttgtcaagtaaatcctgtcgtctccctggggcttctaaactaatatagaataattttcaaatggtaaaattatgactgtcatacaaatataaaataaacaggggtgaacagttttactttcctcatgaattcatgaaaaaacgctgatatttaagcatttatgcccagaacatgcagctggaatggtgaaccatataattttgcacagcttccttaagtcatagctattggaactgtagaagtcaaagcagatggtggtgactccattatttaatctggttcacaaaacatcgtatctgtcacatgctctttgtaacatctaaggtaattacaaacatttattatttaaaatttgatttttataattgtcaaaatatattcaaaatttagttggctaaattggttgaatgatcaaactggacaaccatcattgtaccaggaggctgaaaccatgggctcagtctctcccactgacactgaccaactttgcactcaacactctggaaatccagcatctcattcataaaatgtaaaggtcaggatgcacactctttgagggcctttccagctccaaagtcgatggcaatgttgtcaatgaaagatcaacagatcagtgcattatacccagggtgcttgtacagttaaaaagtttctggcccccttcccagatacaccaaacagaatttgggtggaatccaggaatctgcattttaaataatatccatattattcttatacaaactaaagtttgaaaatcattagtatatggatgtttttcccctgaacaaaaaccagttatgactgaaaaatagttatcgagtttttctggtaagtggtacactactcagtgccttcaagtaaaggtgatctacattacaagttgtctaaaatgatgtttgaaaaggaaccaggttgtcaggttgtcactatttttaaagtggtggtttattatggtacatggttcattataccaactataagattttgagtatctgcttagttcaccagtgaacagctgtgaaccaatgtgtagattcttttacccattcctcttgcttttccctttcttctttcttagaagtggtttagagaaaacaaataaaaccaaaagctggttctttgaaaatataaataaacttggtaaatctttcactacactaaccaacaaaatgagagacaagacacaaattatcaatatcagaacttaaagaggggtcataactaccagtcctatggttagtaaaaggctaattaaaaataccagcaataatgttttacccacaaatctgataacttggtaagacagaccaattccttgaaaaacacaaataatcaaaattcatatgagaagtaatttgaataagcctgtgttattaaagaaattaaatcaacaagtaataaccttacaaaacagaaaggacctggctcagctggaattactggtgaattctaccaaacatttaaagaagaactaataccaatttttacaatgccttccaagaagatagaagtagagggaacatttcccaacttaatatgaggccagcattgccctaatatcaaaaccatgcaaagacattataagacaggaaatctgtagacgaacatttgtcatgtacacagacttaaaaaccctcaacagaatattagcaaataaaatacaaccaagtgtaagaagaattgtatacaactaagtgggaaatattacaggtatgcaaggctgtttcaacattcagacatcaatcattgtggtccaccatgtcaacaggctaaataagaaaaatcatataatcatatcaatggatgtagaaaaaccatttgacaggatctaacacccagtcatgatgaaaatcctcagtacacaaaaaggataaaggaagcttctcaacttgatttaaagccataccaagatgtcagtagctaacatcatacttacttgtgagaaacggaatgctttcctcttaagatcaggaaaaaagtaagatattgtctctcactatttctacacaacactatttctacaaaacattctagaaatcctaagtagtgcaatatgacaagcaagggttatacagattggaaagaaagaaaaccctcttcgtccaccgccataccagcctgaacgcacccgagctcgtcgatctccgaagctaagcagggttgggcctggttagtacttggatgggagaaaactgtcttcattcacaaatgatatgattatctatgcagaaaaccccctaagaatccacaaaataactcttggagctaataagagaataacaaggtcataggatataaggttaatacacaaaagattattgcttttatcttataaatggttgctctttcattgtggaaaaatgttcacccaaataaatgggccttgccactctgagaaggttgtgacccaactgaggagaaaatacatcttcctctgagaattaataagcctctgcaaggaatagcaaaacatattttttctttttattactttatctttctcattttttattttccttggagctgaacaggagggaagctagacaagaattaaaggtcaaatagcctaactagaggaaggtcttgatggttatacttcaagtcccagaaaaaaaaaaaaaagtacagttagatgatagaaaatggagatttatggttgctttacacaaataataaaataaaagacttaaatctttactccacttgaaaactccagaaggatagaagaaattgcattagtcttttgcaaaaatattttgataactttttcttacttatgtgttccatttgtcattttctctaaactacacctgccccaccttgaaatgtttttatctaggctttgaatgcctttgctcagttatccagcaggctatgatcctctgcgtctgctctctgccgatgtgtgagtgcatcaaatgcaagggttgcaagagtaattatgactctgttactgcacagctccgtaatcatgacaataaaacctggtaaaaatgctcagaccacatcttagcctggttccagacagtgttcatttctgaagctcacttttcttggctttctgtgtagctccactgacaagttttccaaacctttgaagtctggcaaaattcccaaaccccaggactcctcaggagagatgcagcagtggaagctgagctgactgcctttaggctgggtcatggcgtccccacgagccttgcaccacccaccatcacttccttgtcacttcagagccctcaacaagacaaaagggctcaccaaaaaaacacctcctctttattacaagaacatggaaaccttttttccagcctcacactggtaataataaaagaatatgctgtctaaagtctttctgtttttacctaggagatggaagccgctaagggtaggtcattagcctatcctgtaagcttttcactcttccacctccacatacaaccgcccctaaaataaaagacccctatgtagcaaaatacctgctcaaaggaatttctgcaaataaaggcacaaaacaggatattgtaccttttatatttttggtgagagtcaagggaccccagtctcggattattaaaattactaaacgtggttcatatcaccaagttcaaagggggtaaaaaggattaagcttcacagcattccacacgaaaatgtatcactggtaatgtgtcttttccaaccacaacaaagatgccacgtgggttgctacatggagaagtgttcaagtattgcgtgtcacaatatagacccggtaaattgtcttcggaactttcacttttccaaaatgggtttctgtgtgaaaatctgcaatgatctgaatcttttcccttgagtcctggtgtttaaaagatagcacaaaagctgctcagaaatctaggcttgacacctgctagctagaattcaaaaaggaaagagtggcaaagttcacaccacttgagaagaagatctctttcagaaatagccttgtggcaatggagagcaatctgcaatttgtaagagttccctgcctctaaacttacttaggaaattattccactgggatgagatttgcctaaattggaaacagaaagaattctctttggaaaattcctatcaaaaagaaaggaaaaaccatgtctcattgccatttccccataggattcttttctacaaacacacaccaagataacatatataagactccaagaagcccattcagagaaagaaatatatacaaaattgcaaaaacagaagataattactgaaaggacaagcataaattaactttttgcttttcctaaaataacatctatattgaaactttgtttacgcttaaccttcggagaattagttttgaaggatttttaattaaactgaagaagtagaatcaagaaagttgcaaaaaaaggggaagctgttagaaatattatgtatggccaggcacggtggctcacgcctgtaatcccaacactttgggaggccgaggcgggtggatcacaaggtcaagagatcgagaccatcctggtcaatatggtaaaactccatctctcccaaaaatacaaaaattagctgggcatagtggtgcgcgcctgtagtcccagctactcaggaggctgaggcaggagaattgcttgaacctgggaggcaggggttgcagtgagccgagattgcacccactgcactccagcttgggtgacagagcgagactccatctcaaaaaaaaaagaaaagaaaaattatgtatgagagaaaacagcaatgctagaatttgttctgtgactccatgaatgggaacaaggaaacataccacaggaagttattgtctacaaatgaaccagatgtgcagcaacatctgaaaacctgctctgccgtggggcactgtaggaagaaatgcaaaagcgagaatcggaagaacaaaggaatgagagggtagagccaagtgccgcaacccagcatccaaccaagaattagagacatcaaaaccccgggatggggccttagactctgccaggaacaaagaagtgggaaataaacgtaaaacaggccattttcaaatgaattgctgtgtgctcctaaccaatccaacagagcatcgtttagctagtaaaacaatatggaaaataaaagttaatgtttgtagaaattcagaaaggaaaataatgcaagaatctaattacttcccaacttagggaggataaaggagaagacacaaaagattgaagtgaaaattgaaatgacctcctatgcttttatccttcctagatttcaatgggcttgctattcaaaaataaattaaaaggttgtgtgtttaacagtcagactacagaaagacagactatttgaaatttataggagacaaacttgtgttttaaaaaataaaaggaaaaattcacaattgtttttccctaattctgggaaaggttatatcacttcttcatctgaaattttcaaaaagtgtatcaatatggcacttacttttctaccaccctatgtagcttcggatggtgtccgacacatctgtaacactcagttctataaaaacttctaagagcacttttaaatgttagcacttttaagattgaattaccctgggagtattgaggctttcagtattaaaataatttctggctagcattttcgagctgttcccaacatcttattaaatacctatagaaaccagctataaaactgaaattcacattttcagcaaactaagactcacagtcagtcagcttacagctcggatctaggaggaatttctaccagaaaatgacaaatctgagaagaattagaatgtgttcactaacaagtaggtcccttacacatagaagcatatatgtaaacattgtcacccttaaagacaggaaaacatcagctcattcacactctgtcctatagcagagaagcattttggatggaaaacaatttctctagatatatcaaacaagagaacatggcacaggatacagcaatttcagttctagaagccatgtctaaagaaagagcctgagattttgaccaaggtttatgtataaaattatttatggcacctgtttaaaaccaaatgaggaaactacaaaccacttgaaccaccactagcaagggaagagttaaataaatcatcacacagccaatgagactacttacataaactgtgaaacaaaaacacgaaaatatgctcacaatacaacatcaagtgataaaaagtagagcacaaatttaggatataaaatgtatttatagtatgaacccagttacgttaaaatcacacatatatacacacacacaaacacacacatctagaaaaaccctggaattcaataaatgagttagtagtggttgtctctaggaggcagaaacaaaacaacattaaaatttctctacactgagcagatggctcttctataataataaaaatagtacaaatattgttatttaaattaaaaaaatcaagtactcattgtgaggcttagaacaacattgaacttttactatcacttattcttgtcttaagagagacaaattaattgcttattcctgaacctcagataataacatatgccccctgggttgggatgggattcagtgaaataatttaatccaaataatatattttaagtgccaagtacaactctagcacaaattaggtatgaataaatgctggtcaaatctgtatacatacattggaagtagtcagtgatctgttcaaaaaaaaaaaaaatccacgaaacttcattccagatgagcaattcaattgctgcttctccacaggcatgggaagctcacacccacacagctgatctttagcgcccaccaccatctggaagatgccttccagtgcagtttgggactctccccttgatggataccagatggcacagaaagtcctaaagacatgcttcatactggtggcagaaacacaggcaagacacacagagatgaaaataatggaagacctaatgcaagaataaacgacccagtacctcattctatagcaagttctcacatcagtgcccctggaataactttagagcatattattaaaactgtgttttcatgtcccacaaggacatagactagattacccgaagacaaaagcatcaatgtgtcaaatgtgcatataggtggcctaaggcaatgagaaataggttttcatttcactttattaacattttatctgaattgcatttctctttgtctggtgctctgtgatcatactgggctgagttattcacagccaggatgctacttggccttccagatttattcttcattatctccaaataaaataattaaattgtatgcaggaatacagcacaaagccaaagatcttgtaatgcatttttaaaagtaaatcatcatccatgcagaaaagcaatataatggaatatttaaattttgccagtgaaaacctccaacaaacctagataatcctgaatctgtaggtgtttcatatttttaatgcagaaagatgtgaaataaatgtttacaaatgcttactttacattcaaaatcagtttctatgtgaagccaaaacatgtaggaaagaggggtctaaaatatttttaacaatttgaagctggctaaggattgagactaaaacagacttcaggccctttacagggaaacaaaacaaaaatgctggaagaaggtagcaggcagagtgatcaatacagaatggtggtgaagcaggattttctacatgcattcctgcctggggcagttctgagtaccccaaaggatcccagaggtcacctgggttggatgagtctcataaccccttataaggcaatgatcacggatcagtatctacccttcagcttttgtccccagtacacatctgtcaactgaatacaaggtaagggaggtgttccgaatgtgggccaaacagtgcactgtggtggttgatgtgtctttctctgtgcaggcctgagtttccattcctgggcaaccccatacagtggaggactgactcagactaatggccagcctctgaactacatgactgtggcagaggttaaagcatacagagagggagggaggtgtgactcagttatgaacctgtcatagccaggagctcacagaatcctctcttggtttcctccaccgccctggctgctcctcacttcctcattgatcactgatgctggcatgccttgggctccatcctatgctctcttctctcccatccatgcactcttctttcatgagtctaaacaacacctacacatggatggagcccaaatccatctctccagccatggcctctccagagcttcagggagtgcatctgactgcctacccaatggatccactgacatttctggaagacacctgtgatttaacataaagcctatcatttcctcctccaaatttgttcctttcatcgttcttcccatcttggcaaatggcatgccctcccccgcaatcccacgcatcatccaggccccaaatctaggatgcatccttcatttctctctctacgtcggtgctcatatgcaaaccatatcctgaccccacctgctccttgccagctctcctacttcctgacttgtctgagctgtccagatctcttgttcacacagtgagcctcgaagctggacccacattgccaactgttggatcctggctctgccacttactcactgagtcaaatctatgtggctcagttttctcatcagtaaaacagggaaaataatattcctgatctcctagggtcattgaagggcttcatcaaagtaaggctggcacccagcaagcactgcctcactgggtcttgatcctcagcaggcctcctgacccgtaaccacagtctgtttcctatgtgacagccagggtcacccattcaaaaccagatcaggtggggcgtggtgtctcacgcctgtactctcagcacgttgggaggccgagggtggtggatcacttgaggtcaggagtttgagcctggccaacatggtgaaaccctgtctgtactaaaactacaaaaactggctggcatggtggcgcacacctgtagtcccagatacttgggaagctgagacaggagaattgcttgaatccaggaggcagaggttgcagtgagctgagatcgtgccacagtactccagcctgggccacagagcgagactccgtctcaaaaaaaaaaaaaaaaaaagccagattacatcactccttcacttagaaccctgtactggattccctttttaatttgaatcaagcccccacactccttcctgaggccaacaggcatgatctctctcctgcccccaccctaactgcatctgctgtcaggagcctccttgtccattacccatccagcacgccatctgtccatccttacgttccccacacatgccaacacatccctctctggagactgtgcactctctctgtctggaatgttctacccgaagtctgcacatggctggcatcttcctgtccttcaggtctcagcccaggttcaccagctaaaagacacctgccttgggtcccagacactctctcacacatttgctctgtttcattgtattcacaaaatccctcatttccttctctcctccctaaagcctctcagttttgaatcccatgtcatcaaattgtatcacccattgaccttcatgaaactgtcaactcacactcaacatgtctagcaagtttgacttcctaggtcagcgctgctttcccatgaccactcctattctatccttggtcaccccatggcctcctggttccttaaacacttctcctccaccagtctcagccactgcatctttcctcctccttcgcctccttgctgacctccatcccctccttctccaactcccattccttgaacagtcactactgctttctttggccagtgccctcaaaactcttggcactcacactttgtcataattgcttggcaaatcagctaccctgaaatccagctctctaccaactgaatgtagcagagaaaacatgttgactaattgcttcttttttaaagaaactatttttatgggtacgtaataggtgtatatctttatggggtgcataagatattttgatataggcatacaatgcataataagcacatcaaggtaaatagggtatccatcaactcaaacatcatcttttctttgtattacaaatgatacaatcctcctttggttatttcaaaatatacaataaattattgttgactgtagtcaccctgttgtattatcaaatgctagatcttattcattctatctaattatatttttgtacccattaactagctccacttcccacgccctcatcactaccctttccagcctctggtaacaatcattctactctctgtttccatgacttcagttgttttaatttttagctctcataaataagtgagaacttatttgtctttctgtgcctggtttatttcacttaacataatgacctctagttccatttatgttgttgcaaatgacaggatctcattctttttttatggctgaatagtacaccattgcacatatgtaccatgttttctttatctattaatctgttgatggaaacaggttgcttgcaaatcttggctattgtgaacaatgctgcaataaacatggaagtgcagatatctcttttatatactgatttctttggggtatatacctagcagtgggattgctggattatataaaggttctatttatagtctagtgaagaacctccaaactgttctccataatggttgtactaatttacattctcactaacaatgtatgagggttccttttctccacatctttgccagaatttgttattgcctgtcttttggatataagccattttaactggagtaagataatatctcattatagttttgatttgcagttctctgatggtcagcgatgttgacccccttttcatacacctgtttatcacttgtatgtcttcttttgagaaatatctatttggatattttgcccatttttgaactggattgttagattttttttgtatagagttgtttgagctccttgtatattctggttactaatcccttgtcagatggatagtttgcaaatattttctcccattctatggattatctcttcagtttcttgattctttccttgtctgtgcagaagctttttaacttgatgtgatcccctttgtccatttctgctttgtttgcctgtgcttgtggagttttactcaagaaatctgtgccccaactccaatgtcctggagagtttccccaatgttttattgtagtaatttcatagtttgggtattaaatttaagtctttaatccattttagtttgattttttatatggcaagatggggtctagtattgttcttcttcagatggatattcagttttcccacatgtttattgaagagattatcctttcaccaatgtatgttcttggcacctttgtccaaaacgaggtcattgtaaatgtatgggtttgtttccaggttctctattctgtttaattggtctatgtgtctgtttttatgccagtaccatgctgccttggttactataactctgcaataatttgaaatcaagtgaagtaattcttccagttttgctccttttgctcaggataactggctatttggctattttgggtcttttgtggttccatataaattttaggattgttttttctatttctctgagaaatgtcattggtattttgatagggatggcattaaatctatagattactttggttagtatggacattttaacaatattgattcttccaaactgtaaaaatggaatatctttacactttttgtgtgtcctcttcaatttcttgcatcaattatagaaatatctcacttattttattacattaattcctaggtatttaatttcatttgtagctattgtaaatgtgattactttcttgatttcttttttggattgttcactgttggcatatagaaaaggtactcatttttgtatgttacttttgtatcctgcaactttactgcattggtttctcagttctaatagttttttggtggactcgttaggttttcccaaatataataatatctgcaaacaaggataatttggcttcttcctttccaatttggtttccctttctttctttctcttgtctgattgctctaattaggacttctagtactatgtggaataacagtggtgagaatgggcatccttgtcatgttgcagatcagaaaggaaaggcctccagcttttctccattcagtgtgaagctagctgtgcatttgtcgtatatggcttgcattgtgtgttgagttatgttcttctacatccaatttttgagggtatttatcatgaagggatgtttaattttataaactgttttttcagcatcagttgaaatgatcacatggtttttattcttcattctgttgatatgatgtatcacattgattgccagtgtgaatcaatctttgccagatctttgccagattttggcaaagttttttcagcatcagttgaaatgatcacgtggtttttattcttcattctgttgatatgatgtatcacactgattgatttgcatatgttaaaccatccttgcatccctgggataaatcatccttgattatgatgaattatcttgttaatgtgttgttgaatttgatttgctaatattttgctaagggttttgcatcaattttcatgggaatattggtctgtaggtttatttttctgatgtgtttttatctggttttggtatcagggtaaaagtggccttatagaatgagtttgaaagtattctttcctcctcttttttcagaatagtctgagtagtattggtatgaattatttaaatgtttgttaatattctgcagtgaaaccatcaggtccagggcttttctttgctgggagactttttattatggctcctatcttgttatttgttattagtctgttcaagttttgaatttcttcatggtacaatcttagtagattgtatgtgtccagcaatgtatctgtttctaggttttcccacttattggcatatagttgctcacagtagcctctaatgatcacttgaatttctgaagtgtcagttgtaatgtctcatttttcatctctggttttatttatttgggtcttctctttttttcttcatctggctaaaagtttgtcaattttgtttatctcttcaaaaaacaacttttaattttgtttatcttttttattgttctatttatttcaacttcatttatttctgctctgatctttattatttcttttattctactaattttgagttctatttgcccttgcttttctagtttttaagatgcaccattaggttgtttattcgaagtttttcttctttcctgatgtaggcacttacagctataaattttccctcttagtactgtttttgctatatcccataggttttggtacgttatattgccattatgatttgcttcaagacatttttcaatttccttcttaatttcttcattgacacactggccattctggagcatattgtttaatttccatgtgtttgtatagtttccaaagtttctcttgttattgatttgtagcattatgtcattgtggtcagagaagatgcttgatatcatttcaatttttttaatgttttaagacttgttttgtgaccttatatgtggtgtatccttgagaatgatctttgcgctgaggagaaggatgtgtattctgcagctgttggataaaatgttgggtaaatgtctactaggttcatttggtctatagtgtagattaagtccaatgtttctttgttgattttgtctggaagatctaatgctaaaagacaggtgttgaagtctccagctatgattgtattggggcctctctctctctttagttctaataatatttgctttatatagctgggtgttccagtgttgggtgcatatgtatttaaaattgttatatactcttatggattgacccctttattgttatatgatatcctttgtgtcttcttacagtttttgtcttaaagtctattttgtctgatataagtatagctacttctgctcttttttggtttctacttgcatggaatatctttttccatccctttattttcagtctatgtgttctttatagatgaagtgttttccttgtagacagtagggcattgggtattgtgtttttcatccattcagccactctttgcgttttgattagagtttagtccatttactaatgtcaccatgtaccaatgttattattgataagtaagaatatactcctgccactttgttatttttctggttgtcttgtggtcttcttttccttctttccttccttcatttcttttttttagtgaaggtgactttgtctggtggtgtgatttaatttcttgattttcattttttttgtgtgtatctgtcatatgttttttgatttgaggttaccatgaggcttgcaaatactatcttagaaccaactattttaagctaataacaacactgcataaacaaacaagcaaacaatcaaaaagtaataaaaatgctacactttaacttcatcctctctctttttaactttttttttgttctagttacacttactgtatgtaacgtctatttcttgaaaactgtttgtagcaatttattttgattggttaatcttgtagtctttatatttaagatatgagtagtttacacaccacaattacactgttacaatattctgtgtttttctgtgtatttactaatagcagtgagttttgtaccttcagatgatttcttattgctcattaacatccttttctttcagactgaagaactccctttggcatttctcacaggacaggtctggtgttgatgaaatccctcagcttttatctgtctgggaaagtctttctttctctttcatgcttgaagaatattttcactggatatattattctaggatataagatttttccttcagcactttaaatatgtcatgccactctctcctggcttgtatgatttccactagaaagtcggctgccaaatgtattagagctgtattaaatgttatttattttctcctgctgctttaggatactttctttacccttgacttttgagtgcttgctaattaaatgtcttgatgtagtcttctttgggttaaatctgcttgatgttctatagccttcttgtacttgaatgttgatatatttctgtacatttgcaaaattttctgttattaccctgttgaacaaaactttctacccctatctctttttccacctcctctttaagaccactaactcctagatttgcctttggaggttattttctaaatctttcaggcatgctgcattctttcttactctgctttcttttgtcttctctgactgtgtattttcaaatagcctgtcttcaagttcacctaattgtttcttccatttgatcaagtctactgttaagagactcaggcatccttcggatgtcaattgcaattttcaactccagaatttctgcttgattctttgtaattatttcagtctctttgttaggtttatccgatggaattctgaattcctctgctgtgttatcttgagttccattgagtttcctcaaaacagctattttgaattctctgtctgaaagatcacataatctgtttctccatgattgatcactgataaccttattaagttcgtttagtgagatcacgttttcctggaaggtcttgatgtttgtggatgtttgtcaatgtctgggcattcaagagcttggcatttattgtagtcctgacaacccgcatttgtttgtactcattgttcttgggaaggctttccagagatttgaaggcacttgggtgttatgatctaagcttttggtcatgtagccatatctgcattagggggcaccccaagcctaataacgttgtggttcttgcagactcatagaggtactgcctttgtggtcttggataagatccagaataattctctggattaccaggcggagactcttgttcttttccctaacttccaccagacaaagtctctctctgtgctgagctgcctgaagctgggaaaggtgacacaggcacctctgtggccaccaccagtgggagtgtgctgggtcagacctgaggccaccacagtgcttggtctcacctaggactggtgtaaccactgcccagctaccaccaatattcactcaaggccctagggctctacaatcagcagctgcaaaagcaagcttaggcttctgtccttccctttagggtggcaagatcacctcagtctcaggcaggtccagagatgtcattcaggagccagggcctggagtcagaaaccttaggaatctactcagtactctgttctaccatggctgagctggcacctaaaccaaaagacaaagtctttcccactcctgccctcccctttctgcacacaaaggactctccctgtgtccaccgccatcccaggcctgtggtgaatattgcctggctactgccaatgttcactcaaggctaagggctctttagtcagcttgtggtgaatgctgtcaggcctgggactcttccttcaggacagtgggctccttgctggcccagggcagtccagaaatgctgtctgagagccaacttctggaactggggaccctgagatcctacttggtgctccatcccactgtggctgagctggtggtacctgaggtgcaagacaatgtctccattactcttcactctcctttttcaagcaggagtctcttccatagacatcacagctggaaatgtgctgagtcatatctgaagccaggatgtttctgagtctcacccagggcccacagtgagtactgtctgggggctgctgttgattattcagggctcaagggctctctctctctagtcagcaggtgatgaatcctgccaggactgggttcttcccttcaaggcagtgggttcccttctggcccagggtatatctagaaattttgcccagaagccagggcctggaatgggggcctcaggactctgttgggtgccccatcctactgtggctgagctgatatccaagttgcaagacaaagtcctctttactctcccctctcctcacctcaagaaaaaaataaataaaaaggaatctctcccagaggtttgagctgagctgcctggagttggggtagggaggggtggcacaagcgctcccttggctgccccagctggtgtctccctaggttgcatgcttcccaagtccactgactgtgagccctggacttgcccaggatttgcagttctggtgacccagactgcctttcaggttgattcagaaccccagaacactttagcccatggtggcaaggcttgttggaactcgggttctcaccactgggataggtgattcccctctggctagggctggtctaactgctccctctgtggacacaggctgagttctgcccagttttgctttccactgtgacagggcagcactgtgttccaatgcaaagtcctgtagtcactgcactctccctcccccaagtgcatggattctctctccatgccacatgcccactgccaggtaataggggagggatggtgtcagcaattcaaaactgtctttcctaccctcttcagtgcctccttcagtgacgtgaaattaaaaagaggtagtgtgatcgctcctgtgacttttggtttttatgaaggtgcttttttgtgtggacagttgtttctatccagagtaatttggtgtttctgcagggaggatgatcagtggaggcttccattcacccatcttctcctgcctcctctcctaatcacctcttaaattcatgaggagattcaagtgggcctttagtgaggtcaggcacaaccacccatgaagccctgttttactcactttcccattcctcctagatgactatttcacctgactttcagcttaatgacgtggcttcctgcttgacgtggaaagtggaagcactcagaggaagatggccagactccccacaccacattttccttcttacagtcgtctatgttgacacattctgccttccatctacaggcattccttggagatattgcaggttcagttccagaccaccacaataaaacaaatgtcccaataaagtgagtcatatgaattttctgctttccaagtgcatatagaaattatgtttgcactataatgtagtctattaagtgtgcaataacatatgtttaaaaaatgtacatacagtaattaaaaatacttttttgataaaaaatgctaacgatcatctgagccttcagcaagttgtaatctttttgctggtgaagggtcttgcttctatgttgatggctgttgattgatcatgagggtggttgctgaaggctgggctggctgtggaaatttcttaaaatgagacaacagtgaagtttgctgcatcgattgactctctctttcatgaaagatttctctgaagcatgcaatactgtttgataacattttacccagagaacctctttcaaaattggaatcaatcccctcaaaccctgctactgctttatcaaataagtttatgcaatattctaagtcttttgtggttgtttcaataatagtcacagcatctttgccaggagtagattccctctcaagagaccactttctgtgctcattcgtaagaagcagctcctcaactgctaaagtttgatcatgacattgaagcaattcagtcgcatcttcgggctccacttcgaattccagttctcccactattttcaccatatctgccattacttccttcgctgaagccttgaatccctcaaagtcatccatgagttttggaatcaacttcaaaactccagttaatgttgatactttaacctctttccatgaatcacaagtgttcttaatgacatctagatgggtgaatcctttccagaaggcttcgaatttgctttgcccagatccatcacagtaatcactatctatagcagctatagccttatgaaaacatttcttaaataataagacttgaaagtcaaaattaccctttgatccatgggctgcagattgatgctgtgttagcaggcatgaagacattagtctccttgtacatctccacatctccatcagagcttttgggaggccaggtgttttttttttttttgagacggagtcttgctctgtcgcccaggccggactgcggactgcagtggcgcaatctcggctcactgcaagctccgcttcccgggttcacgccattctcctgcctcagcctcctgagtagctgggactacaggcgcccgccaccgcgcccggctaattttttgtatttttagtagagacagggtttcaccttgttagccaggatggtttcgatctcctgacctcatgatccacctgcctcggcctcccaaagtgctgggattacaggcgtgagccaccacgcccggcgggaggccaggtgttttgctggtgagtagtaatattctgaaaaaagtttctttttttcctaaacagtagatctcgatggtgggcttaaaatattcaataaaccatgttgtaaacagatgtgctgtcattcaggctttgttgtttcatttacagagcaggcagagtagatttagcataattgttaagggccctaggatttcaaaatggtaaatgagccctggcttcaacttaaagttaccagctgcattagcccctaacaagataatcaatctgtctcccaaagctttgaagccaggaattgtcttctctctagcttggaaagtcctagatggcatcttcttccaatacaaggttgttttgtctacattgacaatcgattatttagttcagtgacattcataacttgtcttagctaaatcttctagataactttctgcaccttctatgccagcacttgctgcctcaccttgcacttttatgttatggagatggcttacttcctcaagcctcatgaatcaacctcttctagcttccaacttttctcctgtagttttctcacctctctcaaaagaaagttagggccttgctctggattaggctttggcttaaggggctgttgttgctgatttgatcttctagccagactgctaaaactttctccatgtcagcaataaggcccttttgctttcttatcattcgtgtgttcacgggagtggcacttttaatgtcctccaagaaatcttccttcgcattcacagcttggctgtttggcacaagagacttagctttcagcctgttttggctttcaacatgccttcctgagatggtttggatgttttttcccctgcaaatatcatgttgaaatgtgacctgcagtgttggagatgggacctggtgagaggtgtttgggccatggtggcatatctctcatgaatggcttggtgccgtcctcgcagtaatgatttagttctcactacaagttcatgtgagatccaattgtttaaaagagtctggacctccttcctctctcccttgctccatctcttgtcatgtgacatgcctgctcctgcttagccttccaccgtgagtaaaagcttcctgagacctcaccagaaggggagtacatgccagtgtcatgcttcctatacaacctgcaaaactgtgaaccaattaaatctcatcgttataaattactcagtgtcaggtattcctttatagcaacaaaaacagaataacacacttcctcaccaagtttaaccatttctagcttttgctttacagtgagagatgtcaactcttcctgtcacttgaacacttagggctattaactggcctattttcaatattattctgtatcatgtaatagggaggcaagaggagaggaagagagatggggaaacagctggtcagtggagaaatcagaacacacacatttattgcttacatttgatgtcttatatgcatgcagtttgtgatgcttccaaacaattatgatagtaacatcaaagatcactcactgatcacagatcatcataacagatataataataatgaaaaagtctgaaacattgcaagagttaccaaaatgttacacagagacctgaagtgagtatatattgctgggaaacagcatagatagtcttgttggatgcaaggctgtcgcaaatcttcaatttgtaaataacccattacctgcaaagtgcagtaaagagaagcacaataaaatgagatatgcctgtacttaccctcagctgacttctgatgcacactagagtttaacaattcaacaaacactgctagagatgaacccacttttctgtgaaaggccaatctttctgtgtgccacataccctgtgacctgttcaaagacattgtccagcacggccccttttctctcctgcaccatcagttttccccctttctacaagatcatttcctttgacatagaagactgctgttaatcatctcatctcatggaaaagaacatcaccccctcccactctgacagttacctgacctgcagctctctgcccctgtacagcaattctcctgggaagagatttctttgctggactcttctttgcttaacttctcttctggaattatttcctgaactcattttcctcatgttccatcaccagccctccactgcactgaaaggttccctactacagttacacaggacctttgtgtcacaaaatccagaggtcaattctgattcagattcctttggctaactggtcatcagctgcatttgacagagctgggaccccctacccactaatggacattgctaattctataagtgtcctggctacctcacttgttgcttcttctccatctccacgtctttctgcatcaacattaagaagtcaggagaaggggctcttccttcttccgtaatgattatactcttttggtaaattcaaccaaattcatagcttcaattctatctgtaccagtcaagattctccagacaaatggaactaacagaatgtgtgtgtgtgtgtgtgcgcgcgcgcgcgcatgcacgcacatgtgcgttcatgttaggttatagtacagttatttaatcaaacactaatctaggtatttttgtaaatgtggttaacatctataatcttgttaacttcaagttaaaaagaataccctcaactctgtgaggaataggcctcatgcaagtagttgcaggtcttaagagcgaaaactgaggtttcccagaaaacaatgaattctgcttcaagactgcagcatcaactccctcctgagtttctagtccaccagcttgcctatgcatttcaaacttgccagctcccacaattgtgtgagccaatttcttaaagtaaatctcttaatgcgtaatatattttatgtaggatatatatcctatagcctagccaagttgacacataaaactaaccatcaaatgatccatgtaccatgaccctgattcatattttcagtccaaattgttttgtgtatccacttgcttactcaatatctccacttgggtaacaacacaatttttaaagttgaactttacctgcagactttttgctctcatttggtggcaacttgatccttcctgtcctgcagtctgaaaatgttagaatcatccttggctcctctcattcacaccctgcattcaaatcctgctggctccgacatctcacagcctccactgctcccacatttgtccccagcaccatgtctcacctggactgctgcaatggcctccagagctgcttctgcccttgtgtgctggggtctgattgcaacacagcaacccaagcgactctcctaatctgtaactgagacaagctatttcttcacactagaccacaccacttctccactgagtaaaaggcacagtccctgcccaggaggcctccagagatctgtccccttttcctcactgacttaaattccccactctgctgtatgtgtaaaccactctgacaacactgtcctccctgtgttcccaaaagacaacagacacactctgctccagtgcttggaccctagaatactccctctgcctgggatctgcttctcccagatgcccacatgctcactctgcctacttcaaggaacttgaataatgcccttctcagcaaggccccctgcatgtgccatttgaacctgcagcctctccatccatcatccctgcctatcctcaccctgctctgacttgtccttgtgtttggagccttctcacctttacccctactattccattgactcattacatttattgtctggtctttcttccccattaaaatggggatagatgtctttctggttttttacactgatgtttctcaagcacatagaatagcatctggctcaagcgggtcctcaataaatatttgtggaataaatgagtcatttgtgaatatatcttgatgtgctattccttctcacttgaacattacagtggaagctccatggagacaagggcttgcctctcttactcaggcccctccagcagtccatgcacagggcaggcctggcaaatacttgttggggacttctgaccaatgaaggtctttggagatgaaagagaggccaattcctacaagttacaggatctcatagtcctcttttcccaaggttcactgtgctgggatttgcaggtttctggaagattttgaagtgagcactctacttttaaagccacagtatccagtttactgatgaactccactctgccttttccccttcaaaacctgatgcccttaccaagctgatttcccctgggtgggcatcctgatgggtggggcggggcggggctgggggggtcccacccacatattaagccctgacttgctggaactggtctgaacatttgtgcctcagggcaagtcaaagcaagacccctttgcaccaagccaggcattgttttagaactctgactccagcactgcatggtctccagctgcagggaccttgtctttacatcactgatgggcgcattaaccacaaactaagagtcgtgcatgcaagaatttcaacctacctcatctgtagcttaaaaacacttttaaaggcaatacatcttttcttttctttctaaagggactaaatgttgccttgtccagtggaaaaaaaaaatctacttataaaaagcattctttgggggaaagagggagtgattcttatctgaaaaccaatggagcaaaaggactaacattttacaagcttcagtaaaacccaggaaaacctctcagaatgaggatagctagggaggacagaaacccacgagctagagggaggtcaaagtcctggctctttagtgggtgttgctgaagttgacaaatagcaggcatttgtgtggtttgcagacatcgctgtccttgcctccccatggctgcagaaggggcgtgtctcctgtcttcatcaaatctctgcagccccgttgccttctccttgccttactctattggcttttgaatacttcattaacttttaaatccagccatttaaatgcttgcatagcctagttcccctttacctaaaagaatcattacaacattgtctctctcctcatatacttaaatcatctcactcaggcatctgcaaagataatctcaacgattctacttaaactccttagctattaagaaaggcagtaacatcaacaggctgagctggcccttgaaatgggagaagctcctaacagcatctggtcagcttagctgatgcaattgcaaggctggcctggagaaggccccatccagagactcctccctgcagaaccagatggcttcaagaatatgtgcatccgtgctgggccctgggagctggggttctacttaaacacctttggacctgctgggacgtccttccttgagtgtaagcccagtttctcaagcccatatcctcttcttttgattacaacattgtaaattattaaataaaattttcatactgatttcctttagagtaaaagaattttgtgcttttttaatggaataagaatatttcaatctttctttcttttctcttggttatttctagtgctttaaaatgtgaacaccaaaactatttttttattataacagaaaagccaaaatattgtttaaaatatgtgtagccaagacaaatcttattatacatgctcatatcttggaagaacttgtgcacagttaatgggttgatgagtgaagcattcaagacagggagttgctcagcactggagtgtccagaggtcttgaaggtcctggttaggagcccagtctccagagctgcgctacctggattcacatcccagctgcatctcttcctggctgtatgaccttggacaaatgacttaacctctctgtgcttcagttttccacagtaaaataagtatgagaacactacctagggcatcaggatgtgaagtttaaataagttaataaacttaaagaacacaggatggtactgaccattgcatgccatgtaagggtttactatgaacattagctcttaatgctctataattgaatataattttgatttggaatatctatctaaccaggctagcaggagtctttcttctgtctctggggtgtcctgtggagagggaaaatcccccaaatccccaggctgggaccaggccaaggtctgtccacagaggacactactgagagcccttgggctctcatacatccaggactcaccacaactgctgggtctccctgaggtccatatgccagaaaatacttctcaagtacctgctcatgtgtgctatccccagcagctggcatgaggcctgagagtgtgcccagcacactggcagagaacattcaatgtaggcaaaggaaaaagaacagacagcctgggaggatagcacagggtttcaaccttatgcataagaatcatgaaaaggtctcatcgtcaaaccgccagcctgcccctgaaaagcaggccagagtaaaaaggttcagagctcacaaaagaaatgtattgcctctcagtcctggaggctgaaagtccaaaatcagggtgtccgcagggccccgctccctcagaagctccagaggaggatccttccttgcatcttcccagcatcagtggctgccaccaatccttgggtttccctggctggtggcagcatcactcgaagccctgtgtgtctctgtctttgcatggccatcttcatataaggacactgttcagattagattaggggtccaccctactctagtatgacctcatctcaacttaactaattacatgtgcaggaagactgtttataaataacatcctactctgagatcctgggggttaggacttcaacatatcatttttggggagacacaattcaacccagaacagtatcccatgttaaattaaaggggctatatatttttcagcaaaaaagaggaatgcatctcttcataaagacatagacatataattttactggaatgaaaccttatcttacatgcccttttcaccatggctacagctccccactctctcatctccccacagccaggtgagttctgttgccatttgttgctatgtgtatccttccatatgcttctatttactcaaatgagcctacacacacctatgtaggcagatactcattgtgtaaatatgcatcttcaggggaggtttttgtcacggttttacaaaaatagaatcaatcatttcaagtgccttttgtaaattttgcttttatcacacaataacatctgggggaagtcctgccaagccatcttccaaggctctaaagcattatctttaatgattgtattatgtattctgcagtgtgggcattagccaaaaattaacagtgattatcttaagacacttgggggtagggtctctcttcctttatctttgtggagatttgatagctgttcaataaatatgagtatgtttgaattgaagctgaaacatttttcaaaaatctcaactctgatagcattgatgccatttatacaattttattccttcttgaggacactgacattttagggtcccagagactatgtttaacattccctataaaccatcacatttatttatcttaccagcccaaggaggttaaagtctccatctaaagacagggcaggaggttcagagacctgggcacacagcgtagtgggcagactgaggactcaaaccctgaactaacaacctcccacacccatcactctctgccatattaggtttcaaaagttacacatcatctcatatgctagacttggctctggaaatctagttttggttgttcccaaacccaccctccaaagttatatgaccactgaaaatatacaaagtaatgaagcagagccaaaaagtaaacaaaaaagttttagcaatccatgacccctgctgctctgcagagaactgtcctaattttcctttgcttatttaaaatcagtgacttgacttcagtcacatatgttacacatacataatctagtttctagaagcagaatagaaacacttactcatacacgactgggcaggatgtcattaggaaaaggtgaaggaggtgacaatttggggttccaggccctgagttgagggaggacagtggtgacctattaaactagacaatggctaagattgtcatgcttgtttgctgtctctgagagcatatttcctaggaaagatgtttaggagtatttgacaaagacccatatgaaagttccttcacagcatattttacctctaactgtctatgaattcatgtgtgactttgatatagatgctgtaaactttggtacacaaagtaactaagtcccatcacagtatggaagggatgtgaatttcaaaggtgagtaagtggtgcctagaatttacctttcttaccttcctgaaatagcacgtacaataacacggttctcaacgtgggctgagtattctaaacacctaggaactaaaaagtttaaaagtgctgacacctgtatttcaatgaattgatttaattagtataggatgtagctgagcatcgagattccataaactcttcaaatgactcgaatatgcagcagaagttgagacccacagccctaggagatttgaggggaaagcattaaaattgttaaaaattagaaggactgtttgtgaaataagataaaattaaggagaaataacctcctttactgagcaatgtagccttctatgagctgcccccaaccttgctcttcagtcccaccttccattcttccccacattttttgttgtagctgaaacatactttctctgcataagccacatcattcttctcctcttatgctttgtaaatattttcccctctcccaggaatctttctctaaatgaatcctgcactttcttggtgattccatctaagtggtctatttggacagaacttcagtggactcactgcatttccctcaactatatgttttggcccaagtttctccacttgacctcagtgaacaccaaagagacagagatgttgcgccatgcattcccatcacctagccaggtgactagcacatcatagacagtcaacaaatggctgtggggtgaagtcaggaagcaaaacagcattaggaagtatgtatcagcttctcaccaattgtagtattgagaaatttatcatcttgacaggcataaacatgtaagagaaaatttgctttgcaaattatagcacccaaaagcttaaaagaaaacatcatgaaaaagacaggtaaaattgaactcattccatctaatatggtgtttaaaaatgtgtctccattttttctttgtacttattatcaaaaaccaggtattgcaaaagtatattagtaatcacattattcttttttcagtctgatggaaatacaagatacaagtggtcctacagaagaactcttccctttggaagactgaaatgcctggtaacacatggctgcaaatgtttgctgatctctctaatcaatcccctgcaagctcactagccaagtggcagtgacactttggaaatatcagaacctggtaatttatttcttgactgtcttcccaaacaattaaggacctaacatctgcgtgctaagcaaccatgggctactcctttccagcaactttgcaagaaacactgtcagaactccttaaaaacaatcaactctgaaaaagaggaccccagagagtgtctgcacttgagtgaatgttgcccaagcaagggcaaacttctgccacatacagcacatgtttttaaagatgaagttcttgtccagggtgtctggcaattgtgtggcactttgaattagactttgcagaatgacagcaatttgaccaacagcgtctgaggggcagatgctttctgcacactctcaagctcaatgtggcacaatccaggcgattttgcaatgctggatgcatggtgagcctgctgggctgtcaacagccgcacaaagtgaggttgtgccagaatcatggggtgttcagcattcaaagagaactcagatatcacctcattcagccccttcacagtacagataaatggagagagaccagagagcttaatgatttcttgttgaaggatcacacatagaaaggtatatgtgtgttcaatccaaatttgcaggcttaaattcgagttctctgcctgcctaatctaaattggctatttgcactgtccaaacacaccagttgatattctgaacttcctttgactttccacccgataagcagcttaaggatgactgactgtattgacttgcccaagtcaagctggggctgcacggatggtctctatccattgcttctgctgtgcatggctaatacagctcccagccaccgggtaatccttgctagcatccagttattttgctgtcactcaccacctctgggcaatctttatctctgacctaaaaacccgtgagagctaattcctagaatttaaagaatttccaacaggtatgtgagagtagaagcatttctactaagatctttgtctcttaaaaaaaataaaataaaaaaggagcagatagccacaaagaaacaagaaaatataattatgggtctatttgtcttgcctttcatctcagagagaaatgtggcatcttgtagagcatgtgggttgatttcagccgaacaacagtaaactcattagaagctacaagatggggtattttagaaaagaatacagagtggaggttgtaagtgaaatatgaaaatgtttttattctaaaactagaataaattttctatgtaaattttcttcatgacacagagataaaattaagtgaaaaacaaaaatagaagaatggtctctaatttttgcctccccaccacaaaaacaggggctatgcaaggacaatgtatgcatttatacacatgcctatgagccatgagtctccattttcttgtttgtatcatggtttcacaaagataatacctgtctcctcctacttaacaacctctaaagcaaatacaacaaaaatgagctagtagacaccattcccatgcctacccccaagtaacttatccagctttgaaagaattaccatccaaaggaggaaaacgggcatcaacccaggagcctgggaaaggtatttgatacaaagcatcaaatctgccaggcatttgatactaagtaatgacttcaaaagcaaggtgaccagaggaagctttagatcttcctctgcaggaacagtttgacttttgctttaaacctggcacaatttaatctttatttgaaggatatacatacagagtcattttcttcattaagctgccttgacgtgcgcagatccttcgacagatttaaatcaacatgcttgaaaaatgggcacaaataatttggcatgtgaaacgggataggatcttctccaataaaacatggaacttcaacgtggagccaattacaacgttgcatagattctaagacatcaccaattgtaaggcagattttcatttttcaaatgactgagaaaaaatgtgtgaattaaggtatagcaggatccctccatgacagcctgtgtaccagatgcatgaatcgatcacaccagtctctccttagtttaaatgtctttatcctgctgtgtggatctggcaatttctcctgccttcagcagcattggtggttgtgtgctaggcaattcttctccacacatctcagtagtcatttgtgtccacctacttcttttcttgggtttggtaagttatgctgtggcaacaaacaccatccaaatcccagggatttacagcaacaagtatattgcaacaagtatattggctgtggttctgcttcgtaagtcctgcagtccagaataaaagaacagcccctactggggacatgccatcctcatggcagaaggccaagaggaactgcagaagagtgtgatggctcctaaggcctctgcccagaagaaacatatatcactctgctcatgttctttgccaaagaaatcacatggtcaggcacaacattatcaggatgtgaagtatgctcctctcacatgcaatgcacaaaggacaggccctggagggagggatccagtacagaggggcagtgaatgttttcaacaaatgttacaatctaccattaagccttcgatggtcactttgcaaggaaatagagaatgtggttattctgacaaagagcagtatttgctccactgataacacattttataccctgccactctgttttcatgcctttttgtgtatttaataatttttactttaaatgccaaaaatatgtaaattttggagataatttaaacatcaattaaactcaaccatatagttagcaacaacatacatgactcaactgaagccacatcggtgtagcaactggggccgagtctacccaaacacaggcaatgccaactgtgtcacggctgtttcccgtcaacggcaagcataaatcatcatcatttgtaagatgcatctcacttgcacatgtgttgaaatgtaaaaaaagaaaaaaagtatcgtacaattaaatacagcattgtgtgtgtctgtgtgtgcatgtgtgtgtgtaaaataagaatttttttttcttttttgagacagtctcaccctgtcgcccaggctgcagtgcagtggtgtaatctcggctcattgcaacctccgcctcccaggttcaagcaattcttccgcctcagcctcctgagtagctggcattacagtcactcgctaccacgcctggctaatttttttttgtatttttagtagagttttttagtggggttttgccacattggccaggctggtcttaaactcttgatctcaagtgatccacccacttctgcctctcaaagtgctgggattacaggcatgtgccactgtgcctggcctataaaataatatttgtttatcagctcttaaatgctctgcattcttgctctttggagcatggtctgtggcccagcactatggatgtcttccaggggctggttaccagtgaaaaatcttgagccccaaccaagactcttgactaagaatattaacaagatctatgagtgaaccatatgctcactaagttagataagcagtattctaaatgacattagtcttatagctgtgaagtgcattatagtggagtgaacacacacacacatacacacacacacacggatcatgggtatgatgagatgactctgctcagaatcctcccttgcagccttggccccagcatgtacagtgagagagaagagcatctcagggttatcccattcagcaggacgagtgcaatgacaaggacagatcaggtatctccaaccctggctgtgcattaacatcacctggcaaagtttttaaaaatgctgaaaccggaccgggtgcagtggctcatgcctgtggtcccggcactttgggaggccaaggtaggtgaatcacttgaggccaggagttcgagaccaacctgggcaacacagtgaaaccccatctctactaaaaatacaaaaattggccaggcatcatggcgcatacctgtgattctggctgcacaacaggctgaggcaagagaattgcttgaacccaggaggtggaggttgcagtgagctgagatcatgccactgcactccagcctgggcaatgaagcaagactccatctaaaaaaagaaagaaaagaaaagaagaaaaatactgatacctaggccctgtcctccaagattcatttggtttagggtacctgtgtttttagatacttccccacatgactctgttgtacagcctgggtgtggggcttccaatgtagaggacgcatgcagatagaaggtccatttgtgaactagaaacagagctatctgagctctcctgtgagcagccgaatcttcttcaccgtcaagatcactgtataaataatatattctcatgtagggggcaggaaagagaacgagatgtgttggatagagtttagtgccaccaggagtcaggattcaagtgggataacaaggacttcggatttgatttgattgcagatccatgtgtcatgtctaatacacattcaatgtagggaaaccacacaaatttgaagtcccaagacctggatctggaacttttttctactgatcatcttttttttacccttgaataacccacctatgctccccaaggctcactttcaaataggtgttcatatcacagaaacacacacatatatgcatgtaaatgcatgaacattcacattcacatatagcaatttttaaaacataatgaacctctgctattttccaagacttttaggttgtcatggtcataaatacagaatgaacccatctgttctatctggtagcctatagatataaacctgggattgatgacatgattactgggagaagtaggctttcttcccgtgttataactttgaaatgtctgacctatcttgcactaggttacaaacactggcaacgatcaacccgacttttgaagtggaaaaattacttgcacggcagctattgacaacacgactttcattccaaaaggatataaaactcaaaagtgagtgtgaatgctggtgatcccatatttctttgctcaggtgtcaatgctatatccctgggaagttcccaaatgactactcctgcttgacgacttaggaggaaacatggcagcgatcattaatctcatggggaaagtggtatgtatgatgaaaaaagatctatatatgaatctttacttctactttgggatataaaaaataggactcactgagaagaagaacatgaaggcctctatatgatctttcttcctccactcagttctgcttttcatctttaaactggtgatattctgatcaaaatgttcattctatcccaaatccaagcatattctcttgaaagtgaaggggatcccacaattaaaagcaaaaatgccaacatctcaccactgtgctaatagggatgattccattgcatataaaagatgcattttcttagaaagaatcttcatgaaacagactttgctcaagtccacctatacatagagcatgaaggtgatcaagagactcttccaggagtttcttctaacacatccagcaaaacacggtcctaaaatggcaggactggaaaaaagagctactcaaaatacatgaggtacttgttttctttgtgggctttttgttcctggagggggaggaattaggaggggaaagggcataggaaatgatgcagacatattgtataaattaggaatggcctaagctaattgaagataaaagggaataaaacacacatgttagggaagtttggtttcaaaacaactcaatactacctatgctgttatgggataatgagcaaaaggtagttctttcaactcaggtaactaagaaagagaaaactaaactttgatcactatagaggaaaccaaatacagtaaatgggaaaaccttagggacagatggagaaggacagtattaagtttgtgggggtgtcataagataggaggccttggaagacacaataaaatcagctcagatgcccatatgcacactcaatgcaggtgctccgctgcagttctcagtcaaggaccaggcctgcagtctggggtggtgagtccttcagcattggatgtggtgtgtggtcaggcagaacagaaaccagatgcagccctggggtgcggggtctcattcagtcaagtcagggaatgagaagctgtgaattattaggctgctgcttttgaaaagtggatagggagacaacataaaacaccaggaggcatggacagtgaggcctggagaagtgctggcaccctgcaagctgatcattctgggtgtggtacccagaccctgtgtctcggtccagaaccacactccagagctgagcctcagatgaaagttggcccttcctgaaggattcagaaacattgtactcaggaagatacagaaaacttcagaaataatgaagcaaaactaacccacagaattaatactttgtgttgaatttaggaatgaactgtgtaaccaggatttgtgtaaccagggttttgtgtcaccaggattttttaaaatcttgtaaccaggatttttaaaaatctctgggtcatttaagtcatttgaaacatctctgttattccagcatattagagcatgggactttttggccttgggttttaaaattttttagttgattctagacttgtggtttgaatttgaaagaaataagatttaagtttgcaaagagtctttgaagttcaagagaacttgattgatttattatatttataagagctgggtaagtgatttgaaggaattggtttattgtaagtctatcctgttagggatataaaaggattcagatatattaaatttataaaatattttttaaatgcttatgggaatttaactacttcagtttacacgtttgagtgcttaagtgaattgtatttgttcaattgatgagttaatcaacaaatattaataaacaaatataagtgatcattcttattttacacaaaaattactaaatttattatttaaaacaaagtttgtcactttaacaggttaagaaaaaattaattttcaacttaaaaattgagcctctatttaaacaattaccctaagtaaacttttctgagaaaatatctttactaaaatgttttttcttaagtcttaactgttatatacctcatacgaattcagaaaggggtcacattttgctttgaaacataagtatggttgttctgttttccttattaaccatttgaagggagaaaaaattatcccaatattgcagctaagtttagagtcctgctgtggagatacagcctttcttggtagaatgtcaaacttgaatccattcaacctacacacattaataatataataatgataatttcagtatttgggtttatctttcacttttgcaaagaataactgtacatattcatgaagtacatagtgatgttttaatacatataatgtatggtgatcagatcagggtaactggcacatccatcatctcaagcccttattatttctttttgtggggggacagatattcaacgtcctctttctagctatttgaaactgtatcatatagtcaactgtagtcaccctacagtggtacagaacactggaacttactctggccatcggcttctctaatcagcgttttctacaaagcaaccagaggcaatttatgattctttctatctacttgaaacctggagacacatgcaccttactaacatcatgatgaagtgtccttggacttgactgctaagactattccatttctaggagactttttccccttggggctagaggacaaagtaatatcttcaaaagctaaaagctcttgaacacaaaaagggcccagcaccatgtctagcacataacaggtgtgcaacataccagggtttccctattctcagctcttttacttcaagccttaattgccttctacctccaagaaaaaaaaaagaaaagtagccaggtctaggagtcaggatgccattggaggtttcggataatgtcttgaggactcagaagatgaagctgctatagggcataatttccctttcctggtcacacttggccccatccaagacaaagtaggaacaatttccttcggcacaggctcaagtgctgaagaagtttttcaagttcatcccctcctggttttccttgtgctctcaagagttcccaatctaagctctaattcagggtcctgatcctgatccttgtgctcagaggaacatggatgtgctttggagcagcccttgaatttgtctgtgttggtgaatttgtgtgacaaatttggggtaagtgtaattgaatattgtcattttatagggagaggatccacagcttccatcctattctctaagggtccagaaaagtgaagctcaaccaccccagacatttcccaggtcctctccctcaccgaaacatactgacctctgtccatttcctgggaacttgtctgcaggcaaatagacaaattaaccccaatgaagatggcaggagatgacagggacctcagggttgctcttcaagagccagaataaacttcatacaacaaaagagtcactgatgtggcatgtcaggacactgatcaaggcattaaaggtgtttgaagattgtaggttaagaatttaaatacagcagaataatttaactcttacaagaccacacagtagacacaaaaatgcttgctaaacagatgtgtccacagtagcccttccctgtgaacaaaagtctttcattgactcactgctcatatctaccccactgggcccaggcaccagccctagcagaaatgcagggactgtcaccctacccacttgctgtgagcagaacctatagcttcagggtagggagaggacaattcaagaggatatggccagcaagggtctcaaataggactttatgcatcatactgcctctttgagtaaggtgaacaactgtctgggttttagcactgaaattcctgcatcctgggaaacctctcagtccccacaaattgggaagatttgttgccctgcatacaaaaatccccaaatttcctccttctgggaagtattcagagcttccatcctaagccaaaacaacaaaagagtggcctgaaagtcctttaaagatgtgtcatttgaaaacataaaggaaagtctttggcgcagaaaatagctattttctggaaaaaaaaaaaaaaaaaagaaaagaaaaaaaaaaagaaaagtgttctctgccagtggcaccacaccaattccttgataactggcagactttgactcaagcagcactcaactttgaatcaaagttaaattaaaaagccctacttcaaactgtcatattttcctccacttgtttcctataactaccccctgctaacccaaacatgtttcccttcacaggactgtccttagtcggcagacattgttgctacagtcactgggaaacactgctccatatataggcaacgtgtcttggagccacatgttctgcccttcaacatcctcctgggatcctcctggggtgctaggaggagtttgattgggctcaccaatcctcagcctttgctagatgaagagcattatgggggatgagaggatgtcacaactgtcccctagaccaatgcttccaacccagatgattatgcctcctccccggggaagacttggcaatatttgaagatgttgattgttgtgactggaaggtttgctactggcatgtagtgcgtagaggccaggggtactgctgacgtaccctacaatgcacaggatagccccccaacaacatagaattcaatgtcaatgtcagtagtcagtgagggtcctctcagaggctgctttatagcatgtggggtacttggaagacaaggcagcccgaagtttgcacatttaccaccttctctgagacacagcctcactgcttctgaatgagaaaaaaagcttgttttagcaggagacagaagaaagcatgaattaacagcaaaaaattctagtctatagaataaaaatatctcctacccagccgaggaatcaggaacaattagtgcctaatataggttgttgatgatgatgccaccggtgattctgcagctcattcctctgttgacttaaatcccaggaatcaggaaaaattagtgcctaataaaggttgttgacgatgatgccactgctgattctgcaactcatccttctgttgacttacgtagcaggctgtttttagcttaattttgaactctttttgaaataccttgcaaattctacaattataaaaaaaaatctacgtagattttaaaaaatgaatttgcaaggtattccaaagagaattcaacattaaactaaaaacagcaccctacataagtcatgttcaactaatacacctgcatatttgcctccaaagatgtgtatacgaatgttcacagcagcattattcacgatagtttaaaagtggaaacaatcgggatacccatcagctggtgaactggccatggaagcatggaacatccacgcaatggaatacatgtgataataaaagggaacgagaacataaatgagcctcaaaaacattaggctaaatgaaagaagccagacagaaaagatcccatggtgtacgatttgattaatatgaacgatcttttcttaaaaataaatctacagaaagagaagattcgtggttgccttgagttgggagagggctcctagggttgggaatggggattgatcacaaatggacatgaggaatgtttctggggtagtgtaaatgtcctaaaattggattatggtgataattgtacaattctgtaaatttacaaaaaaaattgaattgtatacttaaaacaggtgaaattatatggttagtaattacacatcaataaagctcttgccaaaaatctactgaacttggattgtttttctgatatttggtaggaaatgttgtagaaagaacatttaattagaaaaaattatatttatgtcctagccctgattctactcataattaatggcatcactacaaggaaggcattgatttcctcctggactcagtttccccatctgtaaaatgctgagggtcccagaaatactgtttatccttcatgctgtgagctttggttaactggctgctcacatttcaacaggaagagcagatggccacaacttaactcatgagcctgggtcactactttacaacaattaaatcaggcttgaagtccgctttggtttacagagaatgaactgactgtgccaacgtaagtaaaatccagtaccacatggacagctgaagcaatctctcccgcaaactcagcctgcttatcatcagaaaggatgctccttccaaacaatatccctcagaggtatagacagagcatgtctgccatcttcccacacaaacccagggaaggaccaggacactgactacctctcaggcaggcatatacacacccaaagaggttcctctcccctttctaagcctggctatagtgccacttcacctgctttagacaactgctgggacatgcagtgatccacagaccagtatctgcagcaggacagtgcctccccctcaccaatgcctgttaggttgtctctctaaagcgccacttgtcactaggtgggaagaaaaccacagctctaccccttatcatttttaggacattaaaactgcaacaacaaaattaaggggccaccctagttcaaaatattttccaaaatgctgacactttttcattcacaaattcccacctgtgtcatgcatagtgcaaactaattaactaagtatcagtgacaattatagctcctcaatcacaaaattatcttccaaagagaatttccttagcaaggtgaggagatttagccaggctgcatcaaatcagaaacatcatctaagaaagccaaaactgagggatcctgaggcagaggattcaccttgaataccagctgctcatcaagatttattagaggacatgtttcagtgagaacagtagactaagatacacaccagtccagaaatattgaattatttcttctcttaaaacaactcagctgtgtcttttcccaccataccgtttcactgatcctctgaaataatttgcaactctgtcactatatcactaaattagggggcataattctcccaattaagcatttaagtcaaacaagaagaagagaaagaaagaaacatctcctggcatcttttactaaactttaaagtaactgaagacttgttcttgccaaacggtaagtgctaaatcctgagggctgtcacagcttcaaacgagctaacagatgtttgttctcaagcacattttcctctcaatggcattttgagggtatcataaacttcctaacacagtatttcagtggaaacgtttttcgtaagattattttgttatcataaaaaaatcccacaagcatttttgaatatatgttgctctataggaaacaactaatgagatttagcaatgtggaaaaaggtagaaactgccaaggtgagttcatttacaagcacacgtggagatgaaccttaagcaggcctatttctttcctcttttggcctacctcctataactcctagtatagaacagagggacaattggcaatggctgaagaatttttggttgtcataattgggtatgctagtggatagaggccagggatgctgttcaaaatcctacgatgttccaaacagcccctaacgacaaaattacgcagcccaatatgtcaatagtgtagacattgaaaaatgctggcatagacagatataatttcatttgggttcatatctctgggaatgagacatattttctacctgtgtttagcttagtcttagaccagacacataaacacaggtttccaatgtaatacagagttctctcaaatacagcagcctttgtggtgggagggagggtctactgtggaaagaatgggaggtggtgaaatacacttaacacagtgaagagctaaggaagggcttcctagctcttcacataggcctgtgatggaagatgaataagaattggccaaactaaggagagggcaagggcaagtagatgtgtaggcacctccaagtgcctgtgtatagagtgaagggaggaagggccagctctgcagcaccttgaatgccaagctgggttttatctggtgggccatggtcatgagggtcatgggccacttctagtccttctcatgccacctctttcaaattatccattggccctgttgtggactaaatgtttgcattcccctaaaattcatattttgaagccctatctcccagtgtgatggaattagaagatggggtctttgggagataattacatttaaataaggcccttggggtagagcccccataagagtagtacccttataagaaaaagaagaggctgggcatggtggctcaaccctgtaatccccgtactttgggaggccaaggcaggcagatcacctgaggtcaggagtttgagaacagccttgtaaacatggtgaaaccccgtctctactaaaactacaaaaattaggctggcatggtggcaggagcctataatcccagcttctcaggagggtgaggcaggagaattgcttgaacctgggaggcggagttgcagtgagcagagatcacactattgcattccagcctgggcgacaaagtgagagagaaaccagatgttccttcttctctccaccatgtgaggatacaggaaaaaggcagccatctgcaggacaggaagagggccattaccagaacctgaacatgctggcaccttgatgcaagaccaccagaactgagagaaatcaatgcctgttctttaagccactcagtctatgatattttgttatagaagcccaagctgatatttttggaggattaagatggcagataggaggcaggactagcttgcagctcccactcaggtggacacagcagtgtgtggagacttacatcataaactttggctccaagaactactacaggaacataccaggaaagccaagagaatccacagaccctttgaaggaaagggatcaccgttgcaggctccctgagatgccaaaaactgtgagtctgcttgctttttcaagggggaagctggtggtctggggcaagttctcagtcctggtcactggccgcctggaaatagactcaatgctgttgtggggcacagtgggaagtgagaccagcctttaggactgctggctgcatcaggagggggcaaggcctgtgactgctggctttcccacactttcctggcaacgtgcatgacacagcagaggcagccataattcccctgggaacataactccattggactgggaaccactcccccatcccccacagcagccacggcaagccctgcctggggagagtctgagctcagacatacctatccctgccccaacctggtggtctttctctacccacccgggtagctgaagacaaaggtcataatctcttgggagctctatggccctgccaactgcctgagaaacctgaatacttaaccaggcatccctagggcaagcttgcatcttccttatagtaccatagctgatgcactattgaaagcaccacctactggctggcagccaaccaacacaaaaccaacacactaaaccaaaatacaagcaaggaccctcacaaagtctactttactcccctgctaccttcatgggagcaggttctggtatccatggctgagagatctgaagacagatcacatcacaggaccctgcagatgttccccagtaccagcccagagctcagtagctcctctgcgtggctagacccagaaaagcaaaaacaatcactgcagttcagctcccaggaagtcccaaccctaggtgaagagtgcaaagacctcatcaaaggagcaccccgtggaacaaaagaatctgaacaagcagcccttgagtcccagatcttccctctgacataatgtacccaaaggagaaggaaccagaaaagcaattctgctaatatgacaaagcactgttctttatcacccccaaaagatcataggtccaaagatctatggatccaaaccaagatcatagatccaaaccaagacaaaatctctgaattaaaagaattaagggctgggcacggtggcttacacctgtaatcccagcaatttcggaggccaaggcaggcggatcacaagatcaggagattgagaccatcctggtcaacatggtgaaaccccatctctactaaaaatacaaaaaaattagccggacgtggtggcgggcatctgtagtcccagctactcgggtggctgaggcagcagaatggtgtgaacctgggaggcagagcttgcagtgagccgagatcgcgccactgcactccagcctgggcaacacagcgagactccgtctaaaaataaaaataaaaaagaattaagaaggtcaatcattaagcagatgaaggaggcaccagagaaaggtgaagtccaacttaaagaaatcaaaaacctgatacaggatatgaaaggaaaagtcttcagtgaaatagcacaaataaaaaacaatcacaacttctggaaatcaaggacacacttagagaaatgcaaaatgtactggaaagtctaagcaatagaattgaacaagcaaaagaaagaatgtcagagcttgaagaccagcctttgaaattaattcaattcatttaacacaaaaaagaattttaaaaaatggaaaaagcttccaagaagtttgggactatgttaaatgttcaaacctaagaataattggtgttactgaggaagaagataaatctaaaagtttggaaaatatatttaagggaataaatgaggaaaactttcctggcctgctagagatctagacttccaaatataagaagctcaaagaacacctgggaaattcatcacaagaagttcatcacctaggcacatagtcatcaggttacctaaagtcaagtcaaagaaaagaattttaagagctgtgaggcaaaagcatcaggtaatctataaaggaaaacctatcagattaacagcagacttctcagcagaaaccctacaagttagaagggactggggtcctatctttagcctcctcaaacaaagcaaatatcagccaagaattttgtacccagtgaaactaagcttcatgaatgaaggaaagatacagtcttttccagacaaacaaatgctgagaaaatttgccactatgaagccaccactacaagaattgctacaaggagctctaaatcttgaaacaaatccttgaaacacacaaaatagaacctccttaaagcataaatctcacaggactatataacaataacacaatgaaaaaaaggtatttaggcaacaaatagcatgatgagtagaatagtacctcatatctcaatactaacattgaatgtaaatggtctaaatgctccacttaaaagaccacacaatggcagactggataagaattcaccaaccaagtttctgctgtcttcaagagactcacctaacacataaggattcacataaacttaaggtaaaggggaggaaagagatattccatgccaatggacaccaaaagagagtaggggtaactattcttatatcagataaaacaaactttaaagcaacagcagtttaaaaagacaaagagggacattatataatgataaaaggactaatgcaacaggaaaatatcacaatcctaaatatatatgcacctaacactggagctcccaaatttataaaacaattaccctgctagacctaagaaatgacattgatggcaacataataacagtgggggactttaatactccactgacagcaccagatgggtcatcaagacagaaagtcaacaaagaaacaatggacttaaatcataccccacaacaaatggacttaacagatatttacagaacattctatccaacaactgcagaatatacaatctattcttcagcacatggaacattctccaagatagaccatatgataggccacaaaacaagtctcaataaatttaagaatatcaaaattatatcaagtactctctcagaccacagtggaataaaattggaaacaaactccgaaagaaaccctcgaaaccatgcaaatacatggaaattaaacaacctgttcctgaataatcattgttttgacaataaaatcaagatggaaataaaaaattctttgaactgaacaataacagtgataaaacttgtccaaacctctgggatacaccaaaggcagtgctaagaggaaagttcatagcattaaatgcctaaataaaaagtctgaaaaagcacaaatagacaatctaagctcatgcctcatggaactacggaaacaagaacaaacaaaacccaagcccaggagaagaaaagaaataatcaagatcgagcagaactaaatgaaattgaaacaaaagaaaacaatgcaaaatataaatgaaacaaaaagctagttcattgaaaagataaatataattgataggccattaacatgataaacaaaaaaaagaagacagaagatgcaaataagctcaattacaaaacaaatgggagatattagaaccgataccacagaaatccaaaagattatacaaggctactatgaacaactatatgcacataaactagaaaacctagaggagacagataaattcctggaaatatacaatcctcctaaattaaatgaggaagatatagagactctgaacagactaataacaagcaggaagattgaaatggtaatttaaaaaattatcaaaaataaaacatccaggaccaggcagattcacagccgaattctatcagacattcaaagaagaattggtaacaatcctattgacactattccaaacaatagagaaagaggaaattctccctaaatcattcaatgaagccagtatcaccctaataccaaaaccagggaaagacataaccaaaaaaatggaaactacagacccatatccctgaagaacatagatgcaaaaattctcaacaaaatactagctaacagaatctaacagcatatcaaaaagataatccaccatgatcaagtgggtctcacaccagaaaggtggggatggtataacatatgtaagtcaataaatgtgatacaccacataaacaaaattaaaaacaaaaatcacatgatcatctcaatagatgcagaaaaacatgtgacaaaatccagcatccctttataattaaaaccttcatcaaaattagcatagaagggacataccttaaggtaataaaagccatctatgacaaacccacagccaacattacactgaacagggaaatgttgaaagaattcccactgagaactagaacaagacaaggatacccaggttcaccacttctattcaacacagtactggaagtcctagccagagcaattagataagagaaagaaattaaggacatccaggtcagtaaagaggaagtcaaactgtgactgtttgctgacgacatgattctatatctagaaaactctaaagactcatccaaaaagcttctagaactggaaaatgatttcagcaaagttgcaagatacaaaattaacgcacataaatcagtagctctgctatataccaacaatgaccaagctgagaatcatatcaagaactcaatcccttttacaatagctgcaaaaaaaataaaataaaatacttaggaaaatacctaatcaagaaggtaaaagacctctacaaggaaaactacaaaacactgctgaaagaaatcgtagataacacaaatgggaacacatcctatgctcattgatgtgtagaatcaatattgtgaaaatgaccatacagccaaaagcaatctataaattcaatgcaatttccatcaaaatatcaccatcattcttcacagaactagaaaaaacaatcctaaaattcctgtggaaccaaaaaagagttcacatagccaaagcaggatgaagcaaaaagaacaaatctggaggcatcacattgcctgacttcaaactactataaggccattgtcatcaaaactgcatggtactggtacaaaaatcatagaccaaaggaacagaataaagaatccagaaaagaaataaagagtcaaatacttacagccaattgattttcggccaagcaaacaaaaacataaagtagggaaaggccaccctattcaacaaatggtgctgggacaattggcaagccacgtgtagaagaatgaaactggattctcatttctcatcttatacaaaaatcaactcaagataaatcaaagacttagatctatgacctgaaaccataactttcatttgagaagataacatcagaaaaactcttctagacattggcttaggcaaagagttcatgatcaagaacccaaaaacaaatgcaacaaaaacagataaatagatgggaattaattaaactaaaaagcttatgcacagcagaagaaataatcaacaaagttaacagacaacccacagagtggagaaagtcttcataatctatacatctgacaaaggactaacatccagaatctacagagaactcaaaaaatatcagcaagaaaaaaacaaacaatcccatccaaaagtgggctaaggacataaatagaaaattctcaaaagaagatatacaaatggtcaacaagcatatgaaaaaaataccgaacgtcactaattatcagggaaatgcaaataaaaaccacaatgcaataccacctcactgctgcaagaatggccatattcaaaaaatgaaaagataatagatgatggcatggatgtattgaaaagggaacacatttacactgtgggtgggaatgtaaacaagtacaaccactatggaaaagtgtggacattcttcaaagaacgaaaagtatatctattatttgatccagcattcccactactaggtatctacccagaggaaaagaagtcattgtacgaaaaagatacttgcacatgcctgtttatagcagcacaatttgcaatttcaaaaatatggaaccagcccaaatgcccatcaatcaactagtagatatagaaaatttggtatatctacataccatggaatactattaagccatgaaaaaggaattaagtaatggcattcacagcaatctgaatagaattggagatggaattggagactatcattataagtgaagtaattcaggaatgaaaaagtaaacatcatatgttctcactcataagtgggagctaagctatgaggaagcaaaggcataagaatgatacattggacttttgggactcaagggtaatgatgagaggtaagagataaaagaatagacattgcatgcagtgtacactgcttgagtgtaaccaaacacaacctgatccctaaaaacctattgaaataaaaataaaacaaatcaaaacaaacaattaaaataaaataaaattttaaaatgaagttttattagaacataaaaaaaaaagtagcccaagttaactgagacagaaatttgtaccaagaagtggggtgttgctctaaaaatctccttaaaatgtgaaagcagctttagaactggtattaggtagagactgacagagttttgaagtgcatgctagaaaaagccaagattgccatgaaaggactactaaaggggagtctgatgaagactcagaaagaaaagaagaaatctgcagagaacacatccaccttcttagagactacataagtgattgtgaacactgaatgttggtagaaatatgagccattctgatgaagtcacagatgaaaacaaggaacatgttatcaggcaatgaagtaaaggtaatccctattatatagtggcaaagaacttgactaacgtgttcataaatgaagttagctatttagctgaggagatttctgagcaaagtgttgaaagagtggcttggttcctcccaactgcctatagaaaaatgtaagaagagagaaatcaattaaagaaggaattgttgagtaaaaaagaaccagaacttacagatttggaaaatccttagcctatccatatttttaaaaaatgagaatgtttggaagataatattaagggtatggctatttgatgaggagactactgtgagtgtcaaccatggacctaatcagccacctcaacagaagcaagaaatgggattagcaaaaactttgacaagtagtatgaaaagaaacagagaaaatgagacagaatgaaggctgcaaacatataccattcctcagaggaaaaaataggatgatagggaagatgattcagagattattagggctaccactttcaccacaggcttatgaggtggacctagttcctccttggtctcaaaggatggggctaactctctcatttcaataggtcagaatgttcccaactattgccataggggtggggccactgaagatatccttgtgggtgggtccccatggagcaggaggagcagggccagtccattgcactgtgagaatgatgctgccatcattgtcctgctaagacaaatttaaatttttgtcttgctaagaacttccttatgacccatcactccttccttctttcctattcttcccttttggaatgagaacgtctatcctatacctgtctcatcattgcagtttggaagcacacaacttgtctggtttcacagattcatagctggagaggaattctgtctcatgacgaagcatacctcaagtctctctttagactagacttcagactttaaattttagagctgatgctagaataagttaaaatttggggggctgttgggatagaatacatgtcttttgcatgtaagaaagacaggaatttcagagggccatgaagggaatgttacggactgaatatttgtgttccctcaaaattcatatgtcaaaggctgaacttccaatgtgatggtattagtaggtggagtctttgggaggtgattaggtttagatgaggtcatgaaggtagaccctccattatgggattagtgtccttataagaagaggaggagataccaggcctacgagacacagcaagaagttattcatctgcaagccaggaagagggccctcaccagaacccaatcatggttacatcctgatcttggacctccagaactgtgacaaataaatggctgttatttaagccacccagtctgatattttcttgtagcagaatgaacagatgaagacaggtcctctccacttttcacttttcttcatgtccagcttaaaatccttgatccagtaataaaaaccacatcaccaccttgattacattctctgttctttccacctctatcctttatcaatgccaatgaagaccttcattcttaaatgggatctctttgtattccttcttagagccacacatgaatctacaattgtctcaaaataaaatattttttaaaacgcaccttctttctggatgatgccaactatctgacatgcctaaaagtgaacaactcaagttagtgaagatactttcaggctgattgtggtcatcaactttacatggaacctctctcccccatgctttccttctcttacactcattcttttatttttattattgattctcatgtgtgtgaaacacaggtagaacagaggcttgaatgtgccttggtctctgggaggcaggacaagtctacttttagcatgtgtgctaggggaagctatatctcacttactcttcaacagaccccaatctgtcttttgtttccaccatccagtgaaaggcaaggtcaccgatgtctttatctaccaaatccaaagggtgccagtgagatattacttgacctcgcattagcatttgacatattctcgtctctgaaaatattcttctctcttgacttctatgtgtctcctgtggcaagatatgaaagtttcagcccatgtgaatatagaaacttcaccacgcttgggattttctccatttgttttgtgctgtatgagacagattaaagataaattcttctcctcacttccgggggaggttggaagtctttggtcttcatggaaaggcaagccacacctggacttattctggctctgagtttaatgggccatgaggagtaagaagacagtaggtttcaggggggcatggggttataaagaaggtttgagataaggatgcacaagagaactgctagagggatatggaagcaatggagagattaccaccagatggagcccctggaagtgaggtgctaatatctggaaaactgctgagaaggaggaggatccataatccagggagcattagaaaagtggacccttctgaatatcatggcaaagggcattgcttgagggcccaggaggctgatgagaatggaaccttgcctgacaatcacccagtcttcttccaatggaaaatgttgcactattttcacatgaatgtcttctctttgtctacacccacaccagagaaagctcctatctgtctataccagcactttacccactggctgaagacccccagctatgccccaagactatgcctggttcctatcgcatgacctcacgtggatgttccttgttatggtttaaatgtgtgtgttcccctaaaactcatatgttgaaacctaattaccaaggtggtgttatcagaaggtggtccttttgggagatgattaggtcatgagagtaacgtcctcataaacatgatttgtatctttctaaaagaggccccagagagctgcccagacacttcaccatgcgaggatgcagcaagaagaagccatctgtgaaccaggaactggtcctcaccagacactgaatctgctgacaccttggttttggggtttccagcctccagaacaatgagatgtaaatctctgttgcttataaaccacacagtctacgacattttgttatagcagtccaaacagactaaaatttttcttacatattttaaaatccccatacccataagcctaaagagtgaggtctgttcatgaagtgggcatcccctgccccctaaacttagtggtgaagagggacaaaatatgtaagctcaaaggctacaagctaggacagttgttcctgagcctcgtcttacactgccttctccacctcttcctctgactttgccggacgcatttgctccatctcctctgctggttcctccctggttctgaatacctcggaactctgtccttttttcttcttcttcttctgcctagaaaatcatatctattaccatgactttaacaacacccacattctgatcactccaaattgatacattcaggccaatgaaacccaggtttagacatccagctgcttacttcatgtccacatctgtgtgtttcatagacatctgaagcatagcatgttgaaaattacagggcccttatgatgtgtttctgccaatctctccaaccaaatgacaagccatcccttccctcaacctttcaacacaacagcctcttgggcaccctttcctttctcaaacatgacacaccctttctcatcacaggggctgtgcacatgatattccttctgccccaaacttcctccccccgcattgcttgctcttgtcattatttcaactgtcatctcctcagagagactttctctcccactctgtatctaaagtaggtctcactgttattttctatgaattcaccctctatagcataaatcaccattatgtttatctgtattgtccttcacccccctgccccacccaataacccatgaatttcatgagggcaaagactatactacatccccagtacctggaatactgtctggttcggagaaaaagagaagatgttcgataaatattcattaaatgaatgactggtaaacattagagtatacatataataatattatatatatgtatgtatgtatgtatatatatgaagttgaagaggtgtagagaggtgggtaagagatgagttttattttacatgtgttgagcttggaggacatagaggaccaatgaatggatcaatccagcagatgattgggctctaagtgtgaaggtaaggggggccagagataaagatataggaggaattcaacaaaactatggccaaagtcacagatgagaatgaaatggcccaaaaaaagtcagtagagtgagaataggggaccaagaacagaaccccacagaaaactacctagaggttacctgctgctcagtcaccactatttcaccatttccaccaagctctcctgcctactcctctgccttgtctagaatagggggccaggaacttagtaacagtcaccacggtaggcgctgggaataaacagtgaccaaaacaaacttggtcactgccgtagaacagttcatgggtagtgaaagcaagccatgtggacagtcactgggtggcagagaccatgcctcccagtttttttctcttcagttttagttggtcatctgactgcccagaggaaaagctacatttcttaattgcctttcttgcaatttggtgtagacatggattaagttttagcaatgggttatgagcagaaggaagggacactgttgtgagttgaactgtgttccccacaaattcatataataaaatcctaacccctgttgaggaatgtgaacttatttggagataaggtctttatagaggtaatcaagttaaaatgaggtcattttaaacaaggaccttatctaatatgactagtttctttataaaaagggggaaattggacacagagatacccatagagagaagacaatggaagagacaaagggagaagatggtaacctacaagtcaagaagagaggcttggaacagatcttttcctcacagccctcagaaagaaccaactgccaatactcagtcttgaacttctagcttccacaactgtgagacaatacatttctgttgtttaatccatcagtctctggaactttgttacagtagcccttgcaaactagtaaagaaaccacttcgaggtcataactctagaaaaggatatgtatgaacctcctggcccttctcccactttgctggcctggggatgactagacttgcagcagctatcttggatgcagaagtggaagccatgtgttgagtttggcagggccacaccacagttgacaaagcacccttgactgcacccctctggactgttacagaacagagaaagaaaggtttgtttgttctaagccacaatattttgggtctctttgttacagtatagattccttagcctgtattctaactgatacatattgcataaaggtcatggataactgtaaataaagtcatatatgacttccaaataatgcttgaaaatgaattatatttgacctcccatcctaattatacattctacatcaaatttatagaattgaaagtacatcctgccacatctgtctctgcctcctaaccctccagattggctggtctcatcaattctaacttggttttcattattgacttcatctcttttcccatttgcagaccattcaaagaatctcttccaagatttttccttcatattccttaggttaccttagctcctctatttcactccagtctggttttcaagtttaaaatgctttccagaatacaaatctgacactccactattcttttctttccaacccaggcacaattcaacatgattcagccatcatcattacaggtaaagtactttcctaaaacactcatcttcctctgctctgtcttttgctgaggtatgcagccccctttgatgttaaatggacttctttctgtgacagtacttgaagacaatgggatctggctagacatctgtaggtttccttaatgtcagcattaaatacagatttattgttaattgatacatttatgccgagttttctaaatcaatggaaagtgaaaaaaaaaaatgctcacaaaatgctaagaattttttctcactttaaggaaagtccatggcaagaatgttctcttatctaagcaggaatatctagagtaaaaaatttggaaatcaaacatggttactgtagtgtttttattctaatcgattccactgttctcgagcccattttttttcatccagatattccatgaaagttcaaatagggaatacattctacattccagatcaaaatttaaaatcactgaagcatttgtctacaaatgcaagctgattggtcaatcctacgttctttctttattctagaatgaagggcaatgtggatacatctgaatcattcaacaatgacataacttaccttctctatgacccaatttacttgcctaattttggtgactcagtggactaaggagaagatgaaatatggagaaattatatttcttttgctggatctgtcagaaaaaaaaagtgtatgactttggggagaaaaatatccttcctctgactttgcttccacatttgcaaaacaggaacagaaaagtcccactaacttagtaataaattatctcattactgagtgtaaacactgttattgtttagcatttatttctgcaatctgtcaggatattttgaaatttctccatgaactatacatcttaatacagtgtttctccttctctcttcacatggcgtgtcggagaaagcgaggcagaatggtgaacacatgggtgatgtaaatgaaatgctgtttaatttattttcaaatggataaaaggaaatgtaattaagctccctaaaagccttccaaataaacttcccttaaaggagtagaaaaggaggttgtaattgatcaaagtagctacgtcaagtgtcagattccttgacacttggagacagaccagattaagatagccagcagagaatcaattgcagtacaagccagaggcttcacaggactgggggaaaataccagaaatgtggattagatgctggtcagcatcaagaagcaaacacactccatgtctgaagtcttgggcttagatgtacaactggtgtaagtgaaccctctctcttcttaatgcacaaacaagtcaatgtgtgtttatattagataagcagatgatagatgatagatagatggatagacaacagatagatagataatctcctatctttttatttaatgaggaaaagccaagatatcagcctaaaaccactaaaaaagagagagaaagcaagccctatgggtctgcaggtcccaagagaaagacttccttctgctacattgcatgctaccaaggatagcaggggatccacagcaaataatatctactcaagtctgtattgtacatttgttaaattctgatccctgaccaaaaaaaaaaagaaggaaccctggtagaacaactataaatatacatactcaacatctcacatgtcccatagtaaatgccacaaaatgagcatgctttgtatttgttctaaaattgttactcttcagagtattcaaactaaaaacaaaactatatttatatctcaggattctataactccaccagctttggaatggcaagaatgagaagtggtcaccctcttagggtcattaatgttcctgaaacttacacttcatagaaacaggcatttttatcctttttaaaaatatatgtgtatgccctaactaatcaacagcctggacacatagacccaactttgaattgattgtggaattaactctcgtgtcaatagagaggaagtcatcaaggtgtaaatttcctctctcaaggattatatgtctttatcataaaaatcataaaataaaatcatgagtttccattaaaaagtgactattttatgatccacagtttatcaactgtcagctatacactgttttgattctttgctttcctcttttcaacatgatcaaatatgaacatgctattaagtcttaaccctggcatgctatttttgaaaagatattatataatgaatatctgccataaaatagtatataagtatatgtgataatcaatcgcaattgattattttagtttattgtctttccaacaagacagtgaagattcgaagcattctattgttaaaataaggttttaaaaacagaaaaaaaatgaaaaattaccaggaatggagaattaaagcacaatataaaacccctgtaataaagagtcattgcctcacagatgaacataaattgaaaaatctattgctttttttttctgcagacatttctcaggatagtgccatactaccattcatgggagatgcttatcacaaatagtcagaaataatgtatctcagggagaagtatttcattattaggtatgatgaaaagcaatattactagaggcattccatcatcaagttctcttagcctattttgaaaggtctttaagaaaaggtattcacaagcaagcatgaaaactatgaagcatcaaggcagttgatgattctaataatagtataactgatcatttatacactgtaaatataacctactgagctcatcataatgattaaagttgaagtttaagacaatgcaaaataaatgtttaaatgaaacacactgagatgacaacagtggttaacttagagtgggtctgatcagcggtcttttaaatttcattctttctagcttgcaaattttctacaatatataggtagtatttttataataaaaattttaattttgttaattttttccaggcttactaatattttcacctgcaatgtgcttccagtgtgtatgagtcaaaatctttgataggactttgaagtctacaaaagtgagcggaatatcaggaaaactgattttaagcccacatgtcacaagccaaaggaacatgtccgatttaagctctctgtgcacgaggtttaatatctgtaaaaacatcttctcctggaaaaagatacccctaactgaaaacagccgttgtgtcatagagatgggaatgagattagattttattttctattttgcacatgcctacgctttaaatttatttcatttggaaaaaaatattttctgttttcttggaaaaagtttgactttttaatgacaattttacaggcatcaacaattatgcactttttgattgcacagtaagaactgatctagaaaaaattaaattgagatacttttcaaactggaagaaatttaaatcactgaggtaacaagtatggggtttcttttgggggtgagggcaatgttctagttagatagtggtgatggttgcatgatcttgtaaataccctaaagatcattaaactttaaaatggagaattttcttgtatgtgaataatgtctcaaagcaaaacaaaactagaagatactgaggagcatcagatttgggacagaattacctgagctcgtatgaatttgttttcacactactgtaaagacactacctgaaactggaaaatgtataaacgaaagaggtttcattgactcatagttccatattgctggggaggcttcaggaaacttacaatcacggtagaaggtgaaggggaagcgagccttgtcttacatggaggcaggagagcgagagggagagggagagggggagggggaggggaagtgccacactttgaaatcatcagctcccatgagaactcactcaccatcacaaaaatagcatgggagaaactgcttccatgatccaatcacctcccaccatgtccctccctctacacatggggattataattcaagataagatttggatgaggacacagaaccaaaccatatcagagaccattccgtataatcactgtctcctccttgccaaaaagtgagagacagacacaggactcagggacaatcagcagaggctgtcacgtccttaaggccatctcatccataactcagatttttttaaatcaaattgtgttatacaagtgggctcatttggccatattaaggggaggctgtcagtgaagacattttcttacctcattaggacaagaaacattcttgctctctcagagtcagagatttgggcgacattatctctctagagtatatgccttgagtgtggtcaccccaagattttctctaccctctgtagcctatgttgatacctctgtcagttggcttttgctgcataattaaacatccccaaatttagtggcttaaggcaaccaccatccatgtggctcatgtatacaggtcagccatgtgggctgaagctcttctgggctcagctgctcaggtgagtgagctggctgtgggccagggtgatgggtgactgggcaatgtctccctcttcatacagcaggcaaacctgggctctctcatccagcacagcatgcttcaaaaagaacaagtaaagcgttcaagatcttttaagcctagacctggaactgcacaggccacttcatccacatcctcagggtgagactcagtcgcaagtccatcctggacccaaggggtggggaaataggcctcacctcttgatgggaggaagcatagagtcacattgcaagatgtgggacacaaggaggggaaacatgcttggaagcaacctaccgccacacagccccaacaacatagacttcaaaattgtaaacacaaaagaaagaaacattcaagggctctcagctcacacagttaatcttcccagtgggacacagggaacataatgatttaatgacttcgaagccatgtattattcaaagaggaagagttctcactgagaaaacatcccaagtaaactgaaacacatctgcactcctcattactgttcctctccctccctgccctccttagagccctcagttactgctttaggtagataaacagggtttgattcaactgaaaggggagctgtagccattatacaacctcagatgaggattgctgagagagatctagggatggtaaatggcgactcaaagactcctcaatgagtctaagcctagggaaggtgctgagtttgtggttcttaaagcaaaggactcgaggtcaccatcgctcagagatgagacaatctctcagctccatttcatgctgatatatttcctcagatccattacatgcgagcttaatttttttaaggtgaaggtttctgcaacctggaaaacaaagcaataatcttacaatacagtagaattgggcagaagtccccaactatctctgcacatcagaatcgctgagcacacttaataaaaacactacgtcttgggctccatcctcaggcattgtgatccaataggtttagagtttagtgcagagacataatttcagcaagcttcccagttgtctggatgagcttagttttattaggtaagaaatggggataactgtatctgctgcatctggcttccactgatgtatcaatagatacggatgggtgcggcatgctgacatgaggtgcattaaagcagataagccatatcaaaacacaaaacctccacagcaggcaagcttatactgggcatattccaaccttactttgcaagatgtccattttcagttccttgccatctactgattactcattaaaatctaggacattcatgttaacccaggcatactgtaggattgtgtacagctgcaagttacaaatatgcaaaaaaagcgtactgcacaagacagaaatgtatttgttcccatgtaagtatttcagccctgtcatgacaagccagctccatgaaacataaagagacccccagctcctcccatctaaccactttgccatgcctcaacctcatgatataaaataaaattggggatccagaaatcacatttatatcccaagcagaagtctggagaaaggggaaaagatgaagcaaacagccccttcttttaaagagcattcccagtttgcacactctattttcacctgcattccattgatcagaaacttaagcacatggaaaggaagtcactagaaagaaagactggaagattccatctctattccagactgccatagggggctgaaatttctgtggaagaaagataaattgtaggacaagaagaaacccctgccatacccaggctttgtcagaacgcctatctctgctttgagcctataaaattttcataccccaaagtgttcattgtggaattatttattataacagtaaaaatttgaaaacaaataaaatggccaacaataggaaaattattaagtcaactacagtacatcaatttcataaaataacatagaatcaccagaaaagttggttaccaagattatataatcctttttagcatgtagtggtgtctagcctcttccactttctctcttaaatacctgcaaagcacaaacactcacagcactgaaaacccggcctgagagacaagccagttcctccatcctagaggaaataaccacaggcagcacaaagagcttgatttagataaatccaaccaggcttcagttcacagcaaactcaaactctgctttatgaaacaaattcctcctgaaaacaaaaacgaaagaacaaaaacaagaagacattttccatcccccaaacatctgtcccaaggccctgaactaattagtattctggcccaggatcccaggccacccttccaggactgggagatgaacagagtcgattttcccaccagcattcctgagctctcctgccatcatcagcctatatccacatggaaacatgaatcccgggaaagagcttggcaggaagtcaggaagaggagatgccagcagaatgttggtgctttctggccaaggatatctcaggagtaaaactttataggtggagagggagaaagagagagacccttgatagcagtgcaggccaacaactgtagctgtgcaagaactttattggttctaaatataaaaaaacaacacagggagggcagatgtacattaggtgagaaccttagagactgagaatcccagcaggagctctgcacatgaaacagcacctccctttcatctgtaggttcaagaatggattctttcactttctaagtgagcagagagaagactcaagcacaccaccaccaccaccacccccttcttcttcacaagcacgggacaggaacaggtatttccatgcttggtgaggagtgtcaataaaagcacaacctcaaatctggaaaggtcattggagggacagctctttgatgaatcttgtgtattagagagttgaactttacagtcattatttggcatcttaagtagaatgtgagaaggtctcactattttgaaacacctgcagaatgtacacaaggctaggaccaactgaaatgaagaaacaagagcatgatctaaacaggaggtgcctgggtatgattccaaagagatgcaagatgctatggcaaatagaacatttctgaaaggatacatgagaaattgataatagtgattgcctttgagacagggaagtggggaaccacagacacaagcattaactggaaaatcatttggtggtatgttattttgtacttaattaattgtatcaggtttattaaattttcaataaaaagagagatacttgagacaaaaacaacactttcactttggctctttctccgttaatttctagccttatgacctggggaaagatattaaaatcactccacgtgtcagtttcacatgtataaaatctaagacctgaaagtctagcagccatgcccagccctggcaaatgtcacctaaggctggggcttggaagtcaccatcaagaaggggaaggagcattccagttgactctgtggtcatgaccactgctcttgctgtcagtaacacctgtaatcacactacatttttgtgagattggcttcgttcttttcctttaatacactaaattctttccttccttaagactttcgtataggttaatccactagtttttaatgttttgtttctaattttcacatggctatatcttactcaattttctgatactgattatcagatgtcactgttctgattccttgatgtcacttcctcaaaaaggacttccctgaccccccatttatactttctcagaaaattttgttcttttctttcataatatgtaatgtatgcatgtgtaattttttttttttttttttttttgagacggaggctcactctgttgcccaggctggagtgcagtggcacagtcttggctcactgctgcctccacctcccggattcaagcaattctcctgcctcagcctcccaagtagctgggactacaggtgtgtgccaccacgcctggctaattttctgtatttttagtagacacggggtttcactgtgttagccaggatgctctcgatcttctgacctcgtgatccgcccgcctcggcctcccaaagtgctgggattacaggtgtgagccaccgtgcccagcctgtaatatttatttctgtaaaatatatgtaacatatgttatatgtacatatgtccttttccttgcttttcacatacaaatttatatggcagtttattgcatattaatgtattcagagttagacagtattctaatggataatctgtgatttttaatcagtcccctattgatgaaattaagataattttcccattcttttgctggtaaaaattgtgctacaataaaaaacagtaatagcttttttaaaagatactatgacagagataacgttgcaagggtagacactgttgctgctgcaggaagtagacagcaatgatgagtaggtcaaagctgactgctctctcagaatgaaagcatctcttcctctccaccaaaaaaaaaaaaaaaaaaaaatcttggcttggaaaaacagaacaagaactgtccaggacttatgtttttcaagaataactataaaatgtcatgaagaataaaaaagacttatataaaagtatatttttctggattagaaggatttaataataaaaagcaaaccagtcttccccttttgataagagtgtaaaatgctatattttgggagaggaggcaatttggcagcttatcatagcgtttctcaaccatttttctttcccattatcattcccctaaaaaggctttttagatatttttcctcatgctctcacccatgaaattttaatcctacagatatgctgaatatctactcatatgctttatatataactatgctcttgacatagaaacagcaaaattttgtcatccacctccagacaggaagagagggagggaggaagggaggaagggagggaaaagggaagggaagggaaggggaagaggaaggggaagggagggaagggaagggaagggaaaaggaaaggaaaggaagcagaaaggcagaaaggggggaaagaggaagggaaaaaggaggggaggggaaaggacaggaggggaggagagggaaagggaggaaggaagggagggaaagggaggaagggagggaaaggaaggaagggaaggaaaggaagggaggaaggaagggagggagggagggacagatggacggagggaggaaggaaggaaggaaagaaagaaaggaagatatgctcctttgggtacagtttcaacccaactgaaaatgcatgctcactactaattcgaatagaagttgtctccatctgggtccagtaggaagcagaattcaaatcaaatggttcaaagtgccacttacagaatgtgggcaacactgatagaactaaaaaagatatgaggcacccagagacaagccacatggagtggtgctgtcactcaagaagtttgccttggagggctgggggaggaaagtgttgcccgcctgcctcctgagaactgaagctatggcaaaggaactgcccacccagcacaattagcagatgtgtagggcacaggcactgccaaaacatggcaccagctttggagtggaagtgcctccttcccgctctcccaccagctttccgtcttctgcgcctgactccccttagtcaagctcacctggaggccacacctataaaactgacagtaattcctgaaatcatctaatacccagtccataatcctatctctccagtagtccccaaaatgaatcaaggaccactcatgcttctagtatttagggttgttaggtcttttctgatctggaactttcttcataaaaccgacttgatggaacagcagccagatggtgttctgtgcaatgtctcaccttctgaatgtggccaactgcttcctcatggtgccatttagcttgatattctatcctttgcatttcctataaactggaaatgaggcctaatgcctggactaatgttaagcttttctaacaggattacatcacagggatgggtaaggctgtggtccgcctatggctcactgcagtggctcatgcctataatcccagcactttggggggccgaggcaggtggatcacctgaggtcaggagtttgagaccagcctggccaacatagtgaaaccccgtctctactaaaaatataaaaattagccaggtgtggtggtgggcgcctgtaatcccagctactcaggagtttgaggcaggagaatagcttgaacctgggcagcggaggttgcagcgagccaagatcatgccactacactccaacctgggcaacaagagtgaaaactctgaaaaaaaaaaaaaaggcaggggggaagagaaaggaaaagggaaaggaaaggagacacaaggtatctatcccacctggagttatgcaaacatggacatctcctaagtagaggtgatgaaaaccagacccttgcactgtaagatacagcccccaacccaacagaaaactgacttgtgcagtgttcagcttgccaccaaagatgcaggctttcactaatctccagcctaatggttttttaaccaattgatgaagctgttttaaataaattatttcctgatataaaatagcaatgtctaatactatcatttcctttctacttactagctggtattctgtattatctgttctcaggctgctaatagagacatacctgagactgcataatttataaaggaaagaggtttaacagactcacagttccacatggctggggaggcctcacaatcacagcagaagagcatgggatgtcttacatggtggcagggaagagagagcttgtgcaggggaactccccttcataaaaccatcagatcttgtgaaacctactcactatcatgagaacagcacaggaaagacctgcccccgtgattcaattatctcccaccaggtcccttccatgacacatgggaattgtgggggctacaattcaagatgagatttgggtgtggacacagtcaaaccacatcacattcttctgtaagatggaactttctctcaacaactagactatttggttaccctaaaaaacagctcctcctggggaggcatgataactgctcaattttcctgcttctcaaattagagtacatggaattgctgcctcaaataaagtcaatgagatttttcaggctttttcttttgtgaatattgttaaagacacatgtatttccacacattcaatctgtaaaaataacaaaaatagctgtcacgctcaaattgttataagtttagccaatgggagcactttcaagcttaatcctattttttttgtatattcatctgagaaaccttccttgctttctggcacaacaagcgattccagactcattttatacctttcttggcctgaaataagtcactgctccaaggagccatgattccttacaggggtaaatgttattaaaggccaaaatccagtgggttagggtgcccattgctaccaagctgatattgtttctaggccatttcagtggtcagaaaaagaaacggtaatttttataattacatttaacatttacatttaattacatttaacatttacattacatttaacattataagtcatagatttataaaatatttttaatctatcattataatgtccttcactttatcctataaaatacataaaataatttttgtataatgatgctaatatcattactaataaatccataattcacttgaagcttaaaatttctataactcttcttgagctgtaacaaattaaaggtttctattcagttccatatattaatgtcacttaaaataaatcttttccatggtatgatatgaatttgacatacaattatgtttcaatttgctttaaattttactaatacctacatgatcccagggttaaaacaacgtaaaaagaaacacactaaaatgtctcaactggaaactatttcattggtttcttatttattcttgcactttttatttttacaaataggtacataagaagaaagaatacttttgcaaaaagtcagcccactgaaatacattaattagtaaattttccacttaatacaggttagggctaacctatatcgttttaaaggctgttcaagataacttttttataactacacataaaaaaagaggtttgcttttttcagtgaccatgtactacttctgaccttaaaacatatttttgaaaaaggaaaacaaatttagggacacattttagccccagtcttgtttgtcccgtgggcagcatttggcatttactggtcacccctccttctggaaaccttgttttttccatttccatggatccacaccccttgattttcctgccttctacttaccaaattccactggcaatgctgctccttctcaccagctcttaccacttggcattctttagggtctccaatacttctaatactacacaccctcccaggacaatttaatctacccttttagctccaatttccacctctgataatgaatttcaattctataactttacccagctcctgagcctcagaaatctatatgcaactgctgacaggatgtctcccttttccgctcacagacacaacattttcaacaggcaccagcttgagttcatcaccttgtgccccttcctccttcctcctccagtcttcctggagttagaaatggtaccaacctaggggcacagtcatcaggcttcccttcacctgtcacctcctttcttacccacctccagggcaatcccaatcctctcaattctacctgcaacacgacatcgctgtacatccatttgtcctagtccagtccatctcctggattgggcaagcattgtctctagtctattccaacacctcctgcttcccattttcatcctctgtgacccacttgccatgttgtattcagaacaatcttttaaaacataaattgggccaggaacagtggctcatgcttgaatgtcagcacttttggaggccaaggcaggaggagtacttgagtccaggatttcaagaccaacctgggcaacatagtgagattccatccctatacacacacacccgggtgtggtggcatgcacacacacacacacacacacacacacaatcacacatatccaggtgttgtggcatgcacttgtagtcccagctactcaagaggctgaagtgggactatcacttgaacctggaaggttgaggctacagtgagccatgatcatcccactgcattccagcctgggtgacagagacagaaggagaccttctctctaaataaataaaatacaaattaagtatcaggtaaatacctttatctgattaaaatccagcaattccttattatcacaataaaatccaagtttatgtacttatatttcaaacaaatttacctacttctaatccttgcatgatggagtttttcagcaataccttctacgatattccgctttgctaaatgttcattttatttctagaattcaaaatattttctagtaccttcatatttctgcaaagctgtttttcctctacctagaatattacttttctcctcaactcctctttcaaatgcttagctcatactcattctttaggtcttttttatttttatttatttatttattttttgagacagagtttcactcttgtcacctaggctggagtgccatggcacagtctcagctcactgcaacctctgcctcctgggttcaagcaattctcctgcctcggcctcctgagtagctgagattacaggcatccaccaccatgtctggctaatttttgtatttttagtagagacagggtttcaccatgttggccaggctggtctcgagctcctgacctcaggtgatctgcccgcctcaggctcccaaagtgctgggattacagacatgagtcaccacacccagcctaggtctcatgttaattactacaactgaggcccaggaattacggcattttaagtataacatataatgcttccaaagtaccaagtatatggtgtgacatgaggcaggctgttaataaatgttagctatttatataatttaggttgttcatgggtaacaaagtaatttccagactgaattcatctttgaaatcaactgctttgcatttgcataattcatatccctgtttttctatactggaagctaaaaactgtgattttctaatttgcaatgtcatgtagagataagtgggagataacttattctgaatgatacagttgaattccagaccattgtaaacagctgtccattcttacttaaatgctgtaaattttgctttttatcatatatttatattctaaagctgttttacatcagagagatgatatgtcaaccttgaaacatcactgtctagtaacaacaaaaccccaaaataagacaaaactttttattttacttcaggttggtggagaagagtttcattagatctactgggtatatggactctgtaggaacactgattgtgaggctgaggatgtagccagtgctgtgttatgaatacagaggaaatgggctcctgcatagcatggatgataatcaacaattgataaagaacctcagctgtgttgagaacttgaaataaactgacttgtgttggaagggaagccactgaatgcaaggctatctactgctagggagaaaaattacggcaaagtaatcattgtttagccagaggctaaaatttctgcaaaagctctgagataaaaattttgaataataaaggcatttaaatttaaacctcactagcacttcttcttaatcatacacagacctaataattctcataaaaacagaaaagttcagctcttcaccataccatggcaggtgggagacacagaagggggaaaagaatcataacacagggaagggaccagagacaccccacggtcattcctctaagaacatctcaggatgctgagaaattatcttatctttgtgaccatagacaagggcatcatttgaccaatgaccaaaatcatatctgtttctagatctcctcttgaccaaattaattgtactgtgattactgaaattaaaattcatatagatctatttttctgcttttgattgcagtgaagaacaataagcagcactaaattctgtctccgctttcctgctggaaaggaggaacctggcctgctaaaccccagctgagggcttaagccatgggcccaggagtggcagggaactgtcccttcagctccagaataatgagtcatggttgatgcaaataacccagaggagcattcctccagagatcaagacagagaggtaaagttgaagggtaagctaaaaccacaggcagtgtaccccaagcgaaaaaaagcttcagaagaaaaaaaagaggctgagacacaaaaggggggaatgaatcatggcacagcaaagggaccagagatactgcctagtcattcctctaagaatacctcaggaccctgagatttgatcttatctttgtgaccttatctttgtgaccattgaccttgtcacacatggtcacaaggataagataaagctgctcccacagcaggtgggaggccacaagcatttttgcatagaccacccacagctttggccatgaagggaagtagctcttaagggtactaggcctgctccaagatttactggataaaaacaggagcaagagaacagattggatggatggatggatggatggatggatggatagacagatagacagacagacagacagataacaaagggagagatgatagacatagatagttagatatagacagatgacaaagaaagatgacagatatatacagaaatacagataggtaggtagatagttgacagacacagatgacagatgattgacagataggtggatgataggtatatgacaaagaaagagagatatgatagacatagaaagataggtagacagatagatgatagatgacagacacaaaaatagatgacagacacagaaaaatagatgacagactatgtagatgactgacaatagaaagatggatgacagaaaaaagatgatagacataaatagagagatgatagatggttggtaggtaggtaggtagatagacacgtgcgcgcgcacacacacacacacacacacacacacacatacaacagagacaaaacagacatacaggtataaagcttctgagtttctgcattggaagggattttaagatgcctacctgataccaaagtaagaatcatttctctgctatccccaaccaataacgtactaactctgaggtcttcttccttctttctttattcttctccaagagaatattttcatggtcacaaagatcatccagtttgacactttttaagaggtgaacatagatatagagaagacagcaacttaatcaagctgtggcatttttcctgagcctctgttgactcagaggctttagtctttccagtaaattcctatgcatatgaatttttaaaaaatcatctcatgcttgcatgttcttggaaaaatctaagtccattgggtgattgttcaacaccattaagatgtcagcaaatcagtgggcaaagtttatgaagagacatttacaaaaagaagaaggaaatctcactaacaagcataatataattataacttctggagagtatgctggtgacaggggaaacagattgcagttgggactgtaacttggtggaactcgtctcaaggcaatttgagaacgttatcaacaacagcaaatacgtttatttccattgacccgggaagctcagcagtagtattatatcatgaggaaatactgataatatagagcaaagtattatgcacattttccacagggctatgactagaagcaaaaaaaatatatagttatataaactatggcatagtgtcacgaaacaataaaattttatagcatttagaagtgtttgttttattctaaatttaaaataacagaatacagaaatatatatatgcaatataatgtagacatttttaactagagaaaactgctaaaagaaaattcagtgaaagattaaacgtgagtatgggggatgcaattacatttttgtttctctgtgtgcaaacttttggcaattttgttttctttaacaagcatgtttctgtttttttttcaaatcgtaacatattagttttaaagaaaaactaggcttattatactcatttttttagatttctgtttcatcaaggggttactgtaatatcaactccttgtcttttctcctccaaggcaaaataattcttgcttattaaacctttcttcacaagtcttacctcccagctccttaattatatttgcgatttttatctgaaaaggtcgttaggtctttctttaaaaattttccaaacaaaattctgacatactagagagcccactgaatcacttatttgttgggaaattcttagagatatttcagtttaactctgacaatttcgcaatggaaaagaaaaaggaggccgagaggaatgacgtgcgcttcacagttttagaaaaagccaactagcaccagggccagccttcttagtttactctctttcatctacataacctgttatcaagtccagctcatctccggcttaggttctttgtgtctttgatctgctgaccatgctgggtcttatagttcagtaacatgttaaacataaggatcaatgaaaatatgcatacattgacatcttggcatttcaccagttttcagtgaaacaaacgagcaacacttttccttcttttgttccagatgtccgcatgccctccttattcacatacaagtaaggtgcagaaatgaggttaagcagagtccaacaagtcactcatcaaaacatgctggtgattgtcctgaaatatgatctcagactcatggctgaacataggtgtgcattcatgtttcaaggttttactaaaaaggtgaaacgtaaggcaaaactatgagaagggagaaggtggacctttccgccatcttctgctcccagccagggttctcctgtagctggaaagcagtgcttctctcagcccctgtcgataggaatccctgcttctcaagtgttcctctaagcagaggagaaaattaactgttgggattcaaaggtgtcccttctaggacacattgcctccatgtaaatcaaaagcaaaatgagccaactatgtggcagctcattccacacaagtgggcaaactttggtgtaagattaatgaaaagaaatgaaaaagacgtagcaagccaaaatacccataatacaattgaagcactttgcaaatattcctctatgtttttgtaaaccgaaagttgtctgagacaggtctcaatcaatttaggaagtttattttgccaagtttaaggatgtactcgtgacagtgacacagcctcaggaggtcctgatgacatgtgtctgaggtggtcagggtacagcttgcttttatacattttagggagacatcagacatcaatcaatatgtagaagatgtacatcgttttaatcaggtaaggcgggacgacaagaggcagaggctttcaggacataggtagataagagacaaaagattgcattcttctgagtcctctatcagccttgcactgaatacacagtttagtctggctcagtgaatctgcatttatcacataaacagcagggcagagaaagcagccaggtatgcatttgtctcaggcgagcctcagagagatgactttgagttctgtctgtcctttgtccgtaaggaattttcttgtaggcaaattgtgaggaaggtatgcagctttttatctttgtagctatcttatttaggaatacaatctgaggcaggtttctgacacagttcccagcttgattttttcccttggcttagtgattttggggtcccaagatgtattttcctttcacattttataactgtaacttttcaacgctgttgctaaaagtatcctttattatggaatattttctttgtgagctgtgaaaagacaaagttaaggcaaaatgacaaagaagggttacaaatgaaaagatgccctgatgctgatggataaatgcaagctggaagacagctgggtgacaacttatgtcaggtaaaaagggacacattgatggtatcaaaaaacaaaagaagattaagaacaaatatccataaaagaagaaaaatacttgtgtggtacaaaggaaaaatcaccccatcagattaggcaaatctgattaagagtgaaacatatgaatataataaaaatataaatacagttgtatcacatgaaactgctgttttggtaggtcaagaatagttgaatattggtaatggtttagcccaaagaattcacttagaggaggcatagacttcctgttgcatgtgagaattgagttcctgcaaaccagtccttttattattgctctaaactttccaacttttaaaaaagaccctgaggcatcagtgttggcttctcagagccccaggtgagtaaagcagaacagctgacattgtaagcaggcgattcctgtctggtagggccactagctggtgactcctttgttcagtacggagatggattcagctccccagctgctcccttaatcttcaccacatcccccttccaggccctacctggaagagcgtaaggtccctggctgtagggaaagggcaggaagcagagcagaactgtttctgcgtcaagcgctcaggagctaggagctgggagctgggcgcactgacttgggatcccaactgcctgggtctaagccccagctgtgcttctccccagagtttcctcaacatcctgtttcctcgtttagaaatctaagccacagaatcccatcttagtgggtcaagtgacccccaattgagttagcacatgcaaggtgcttaaaataaacagtacctggcacaaaaagaaactcaataaatgttcacaattgtgattttaatcttttgtgtggatgagtgcagttgcagaaaggaaaagctgggtacacataaaaacagttttaaaaaatgcccagagtacagagttatttacgctaatgtgttcacacctatggagaaaagtttgtagaatgaaaaaaaaatattttaaagatcaaatagagcaaagcaaccacagcaaatacttgtatttctctagtttcatcttcagacgttccccagggacacaggcaatagctccctcccctgcattagaaagatgactgtcaaaattaatctgcagtattaggggtagtgctgacagtttcatctctgtaaatgttattactgcattaaaaaaaaaaaagaaacccacaaacctctgcccatctttgtagtccaggcacttggagagttcttacggggagaagcacttctccccatcgatagaaattcaatttgctgcacaagttaagatgcagtaaacttgtctctcccttgctttactgctgctttcacaatcataaaacgagcctaatgtttaaatgttagaaagcatttaatatttaatcgttggagattaagtctctttcatgacgcctgagctgcccagcaacaggttagaaattgattgtctgccgacccctaggggcacggcagcagctcagctttcaacatctgcccccagctttctaaggctcagaaacgccaaaggaaatgaaaagtttcctcttccaaagcagttgccagttcctaggggccagcacatggcagcatctggaaaggccaaggggagatggatgtgtgcacatgaaaatgggtgatgttctgggacccaaatatctggcaacaggagaacagcagagccagggcctcagagaagctctctccactgtggccagggggagcccttgtgtccccacattcatgtgacgctacactagaaacaccttttttctgcccactggacatacattcagtgtcaggtgacctagacccattcacagatatctgctggcacttcacaccatccacattttttttcttttgtgcctgtcaataagaacagagaacacaggcaaaagaaagaaaggaataattgcttgctgtcacctattcagcctctaatagagccaattctgaaagaaaagaattcagtgctacttcccagcaggatgctgacaccatgaatgacatcatacagccagacctcaggcaaccagggagcccgcatgaaagacgagtgatgccaaggaagaacacccatggtgccacctgacagtcatgtcctgcaaagtggcagggggagaggaagcctgggagggcctgggttcaaatccctgctgggcccctctcccacagcctaatgttgggcaagaagaacctctctcaactcagtgtccttgttataacaacaggcttaggatgccttgatcccagggtggctgagttaaaactgtaggaaaaatcatttaggaaaaaccctataaatgtttgttaaaactggatctgaaatgagttaatcatcagaccccagataaaatcagttatttgtgtgtgatatggtttggctgcgtccccacccaaatcttatcttgaattcccacctgttgtgggagggacccagtaggaggtaattgaatcatgggggcaggtctttcccatgctgttctcgtgatagcaaataagtctcatgagatctgttgcttttaaaaaggggagtttccctgaacgagttctcttctcttgtctgccaccatgtgagacgtgccttttaccttctgcttgtgaggcctccccagccatgtggaactgtaagtccaataaacctctttcttttgtaaatttcccagtcttgggtatgtctttaccagcagcatgaaaatggactaataaagtgtgttatttggaacttcagtgttaaataaattctgtcatcatcaaatcccttcgtgggctgaagtttcttgaccttggcactactgacatttggggcaggataattctttgttggagggctgtcatgtgcattgtggggtgtttagcagtatcgctggcctctactcacaagatgccagcagcatccctccatacgccccaggttatgacaaccaaaattgtacccacatattgacaatttccttggggcaggaggaaaatcgccccaggcaggagccactgctatgtataatggaatgctaagaggaataactacaggaactattctttgctgcctatctgctgcatattaaacatagtgagataatagtagaattagaaagtgtccttttcctgatggttagtgataaccgttccataaagcaaatagcaaaaccaccccttgttcccatatctaaagtcagatctcagcctgctccagggacacaaacacaaagtgtgactgggaggacaaggcttatacttgaaaatcattgcaagattttgcttatttatatcagcaaaaaaccaagaaacatgcatgaggatctaatgatgttcgactaaggagcaggaaatgtaacactgagttggtcttaacattttaatcatggtgcattgctgagagattccagatttaatacgttattttatgcagatggaagtggctctaacacgtgactggttggctggctggctggctgaaattggaactcaatggtgaactgtttttaatgaggctgagatgccagaacttccctggaatactgtagaagatgaacccaaaggcttaggaaaatagaaatattggactacaacatacatgcacatatgcacacatacacacaaatacacacacatcactacattcacagagagctcccacagactcttcccgaggcatggagaagtgaggagacccccgcatcctgaagaggtctgtgccagctgctctctgtaggctggttatggtgacggatggggtcctagaatagcagaggccacatggcagcccttaactagaagagagggtgagcatatttaccatggggacagcaaggtttccaggaatgttttaatccgcaggaacctttggtggatgctaattgctcggagcatgccttggaagtaaataggcgggcagcttcctaaattgttcctggatctatatatcaaggatgaatttgcctctgctggtcagaatggagcgatggcccctcgccctgtttccaggctcaggacctgcaccttcctgtgggcctggctcctcccaaccttctcaccccagacttcttgcctcctgctttgttctgctttcctccattgcacacacacgtctccactggaaacaccttcttcatttctttaacaaatgccttctacacaggaaccgtcttggctttgggatacaaatgtgaacaaaacaaaaacccctgcctcgtggagcgacagcatgttttgctgattattgcagcatctgggatgtcatctgtcttgtttgttgctatgggcccagcactagaaaagcacctggtatatagtaggttcacattagataggcactgaatggatgcctgcactgtctgctcgccattgagtaagacagtctgtgtctctttcatggtctctctttactcaaatatctgtgagtcccagcattgcttcctcagttggatcacatcacagagcaagcttcagctatggtgagcatctctgtcaagtccatggatgaaatgcagagacaacccccccagggcaggagtctccaaaccaggatgatgatcagaatcactttgggaagctttgaaaaagcacagatccctgggtatagaccccagaatttctgactttccaggtctgggatggggtctgagtatctgtaaaagtgcccaggaatcttttggtgctctgctgtggtgcgccccgtctctgcacctctagtccatcctcacccttctccaggcatatctgtgggcccctggtttttttcccagaagccgagtctgagaaagatcaagagtatgtgggaaagaggagaatgaaggagcgaatagaatacgcctcttaaaatgtagacacccaatctgaacatctgcccctcatgccagccaagacagctcctgagccatattttttcatccctgatatgcgaagaaaaagctacaaagcaggttgcctgttatgcatacatgatgtgaaatgacacctcaaggtacagctttctgttcttcagcagctgaggttatcactgacatttgcctctgattctcatatccacagttatgaagatggaataaaccaggggttctgagagctttaaatgctggacagtacttctgctccgaaagcacaactctcctctgcatcaactcctagcaagcccaataaaatggattcttggatatacattttttaggaagagagtaagatgcaatgttctattaggaaaggaagctcagttccttaaggtcatcttcaacgctggaaatgattcacatttggaacactgacctcccgtgctttttctgaggtgtgtttcaacaccaacagcaggctaaaccaaacatctgaaatgcagtgagagctggatggttagaaggctctggtttcagacctggactaactggacactgaaatctgggctggagtacttattccagaagccgatggaaaaacatcacgttttaaaagtcaaatccttgactcaggatcataacatcatcagcatcgagcaggtctctgttatcaccacagtgatgaagcctgagctgcgcagccgctagggtaaagagggctctgtgctcagctctgtgaagacaaggaggcagattctcaagagcttagagctttgcacagctgcagagtgggcagggatgaatgcaggagagggagtgggaaagcagcacagacacggtaaaaggaaaaataatttaggctgatggaactctcaggtttccgacactcaaactgccatgtgaaaagcaagtggtaagaattcatatatgatatcagcaataaaataacatcctgttgtacaacaaaatacactgaaagacaacctttagtcttttataacgacaagcagatctcataagtaaatgaaaagctagtccattactctttttattccttaaaacaaaataaaaaaagaaaagctttcagtgacatgatgaaattactatcacaacactcttgacaatctccaaatagggaaggtgtgtttctacgctgaaacaggagaaattgtgcttgaggaatccaataagtacaaagtgactcaaagctctatcacagctgtcaataaagaatgaacagacaaaattcttcacaggcttaacatgagaggcattgagcgttttgcaaggctgaacaacagacgggtagtttttgcatgtgcagtgctgtcagaagttgtaaaagtaaacacacgtctttttttttttaaggtagtccattacaggtaattacatatttaaagtatagtcatttttcctgccttccatatttaactattcttatctcagtcattttaatacagaatacttaatgtaatcgatttttatatttctaggggaaaggaaacttctagcccctttgcaggccaaacccaatttggcttaccattctagactttcgtcctcccagaaggattctgaatccaactctttaggaaaatgactttgaatgggttgtgattacaagcaaatgagatgaaaagagtcaacgttttggactcttgctctccttgctaccttgtatttcagctgcataaagttccctggtgagattttgccacctatgtcattgattacatcaatgtgagctgcaggaagggtgagctaaactgaggactgtctgcacaagtgagatattcctcactcttcttcaatttaccacgaaaacagggtagctctgagcctcaaaaaagtgtagctcagacttctgggattcacattaactcatccaaccatcgagtttacatctcctgttcaatctctttcagagttctttatctgaatgaatggcaccaatattcatcttgttttttatccttcccatctttctcctctaccatccatttttagttattcatatcttattatcttttggtggtgactataaagattagggcatgcactcttcttgactatttaaactctaacatgaattaagatttttaccactatcttaatgttacattaactccatttattcccttatgttttttgaattgttgtcatgcattttaattctatatattcctatatattttagatcccaaggctttatcattttgtacagtcaatgttcatttatatttatcacttatgttgctcttcatttcttactgtatttctgtgtttctgataggattacttttattttccctgaagaactccattagaatatttttagtgaaggtgtgctagtaacaaactctttcagtttttatctaaaaatgttatctattcacattcactttatttttcattttattttatttatttatttatttatttattttttttttttttttttttttttttttttttttttgagatggagtctcacactttcacccagctggagtgcagtggcacaatctcagctcactgcaaactctgcctcccggtttcacgccattctcctgcctcagctcacatttacttttaaaagacatattcacaaagcacataaatctaggttggtctttcagcactttaaagcttttattctactgtgatctaacttccatcatattcatttagaagtcagctgtctgtcttatatttctaccttgagagcatgtgtcctatttttctctctggatgctttcaagggttatctctttgtcatttgtttttgcaagcttactttgaatttatccatattgagaatcacagtgcttcttgaatatggtgctgaatgtctttaatctgtcatttttctcttgaaatattacatattccctttcatcttctccttctaggaaaaaattatacatttattggtgcctttcgccatatttcacatgtttctttacttacatacattcagcattccactttttgccttgctgtagttcagcctggatattttctactttcttagtttgtttacaaattctctattctgatgtactgaatttgctattaaactcatatcatgagttgtaatataatttattaaattttttagttttagagattccatttaactctgttttataaatttcagttcctaaggacattctccactctgttattctattttcttgaccaaaacatgatgggaaatgcaatctctctgggatccttagcatccctttctgttcttgctggtggtgccaacaataaaaggctgtggccagtctacctgggccattttccaagactgtgtttgtagtcagtaattttgaggaataatgtaatgtctccctccagaacagagagcaagctttcttagtgtttgctataaaagcatgggattctctaaacttgatgttctccagctgtgatgcaaacccactgcatgtgtagcattcatctgagctatatagcattgcccctgtggaatttggaggccaggaggcaatgtgaatatgcttacatccatcatgtgctcgctgagccataagtaatacagttctttctttgacctagaagtctcatgttctcttccagcatttgtaaagcagtaacagattaacttatctgtaagtaaggtgaggtcaaattcccgaccaggaaaccaagcacaattattttaatgtatgtgtgtaaaaaccttcatcacttgtagatctgtgtctgtctctactgtcctttgttttttcttagtcctgttttttggtgtgtctcataattttttattgaaagtcagacattatctattaaaaaatagtaaagcccctggagcatgttatcttcctccagggaaggttcaacctatattctggtaggaagtctttctttctctcttttttttttttttttttttttgagagacagtctcactctgttgcccaggctggagtgcagtggcacaatctcagctcactgcaacctccacctcccaggtttaagcaattctcctgcctcagcctccagagtagctggaactacaagtgcccaccaccacggccggctaatttcttttgtattttagtagagaaggggttccaccatgttgtccaggctggtctcaaactcctgagctcaggcaatctgcccgcctcagcctcccaaagagctgggattacaggcatgagccactgtgcccagcacagtctgtcttttgaagcagctcaatccacccagctactaagctgatttgtggcaaagttgcagtttttacaagtttctatctctggcttatctctactcctagagtctagttttccatgggtcctaattggaagcctgaaacctttactgtttactagggcctctcctgcttggtaagtcttgacctctaattattgggtcataactgccttgcgatggccaaaatctcttctgtacttttgatagctttctactcagcttcttagtctcttgcccatacaatctaacaattggacaaatagcttgaggaagaaaaccatgaatttgggcttatttccatatgccatgctcatttataagaatctagcatctctgttctgcccatcttggacacttcaaattacaaatttttgctatccaaccccaggctaaaagttcagctggcttctctgccttttatgcaggactcttttcctgtcttttttaacctctcacttactgtaaattctctgagggaagaagtagctcacagaatgttggctcacctctctataattcttttccctctggattatttgtgattgaagtttttgttgcttcagcagttcttccatgtctttaatctgacttttaaataaatatttactctgtcttttctcattttgtggaaaagtctttggtcttccacaacccaaagtaccatttctgacatgcccttatcctttataaccagtacttcctaaatgtttctcacatcattccacttttctccatctcctccaccattaccatttcacttcttacctacagtatagaatatcttgcaactaatctatcttcagccacgattttcacttttaatctgttctctataagcaactatagtgatattacaacaaaaaagtattagtttcatatttctgtatagcaaggtgccacacatttaaccgtttaaaaccaaacaagtttactatttcacagtttccatccatccagagatgaagggtaaaccacgaaaaatataaagcattttcaggctatagacttaataaagaatggtagcctcaaaattcctctgtttctgaagtgaggagatggctgggtaccagaatatgaccccagtagcacaggaatccaagcacagtttagttaagttctctgttcagagtatcactggtcttcaacatagttgcaagctgggctacattctcaactgaaggcttcactgtggaagaatccttttccaaactcattcaggctttgcagatagacaaaaagctagagccttttgttggctgtctgctagaagctgccctcatattctagaggtttcactcagttccttgccatgtgaacttcctcaacatgcctgccctcttcatcaagctagcaaggataatttcttgctctagtatattaagacagaatcctacataatgtagtattatcattgggaatgacatctcatcatctttgcgtattctactggtgagaaggaagtcacaggttctacccacactcaaggaaagggaagtatgaaggatataaaccaggagggctgagatcatggagacaatcttagaattctgccatttttctattatattagcctcttcccagattaaaacccttccatggcttcccattgctaataggaaaaaaattttaatgacttataaattcctgaatgatctaaaccctaactctctatcttcatctcatgctatgccctcccttattacttgtattccagtcacatttttcagttctttatatttgccctattctttcttaccacagggccttctacattaattcttacctaggtcatgcctgttcattctttaagtttcaatttaagcgtgatttcctatgtaagtcttccctgacatatttaaacaggataaacctcattatatagcctcaaatacatcttgtttgtaatttcatatagtgcattcacttatttacgtgattatttggtttcagcacatctcccctcctagactataagctccataaaatcagatgctttctctgagtttggctccattgtatcctaattagctatgaactctatattctgcttggaagctttcagcatttttttaggccttttgtaatagatgaacttttctacaaaaaaagtaagctaatcaaagagctttctaaatcatctgattctataaaccagagccaggatgaaagagagtctgagaatgaccgtggcccttgccaggtgaattttcccaaagctgaggtctgaccatgatatttacatgatcaatgtcttcaatagtgtcaattgtcatcaaaaattttttacactccttattggacataaaaggccctctgtgacctggaccaaactaatgtttccaaacctatttcctattacatcctgctatggactgaatatttgtgtccctccaaaattcctacattgaagccctaatgcccaatgtgatggtatttggaggtggaatctttgagtggtaattaggtttaggtgatgtcatgggagtggagccctcatgatgggtttagtgcccttataagaagaggaagaaagagatctttctctccctccaccccacatgcaccaaggaaaggccatgtgagcacacagtgagaaggtggctgtcagcaagctggaagcagatcttcgtgggtattattggtatatttgcctgacagattaacatgtgttattaaatttaaaaactagtctgttctgctttatctcccccgtagaatctagatatgttgcatgcagtaaacatttaatgatatttgctggataaatttgttgcaagtgaaagtagtttctgggcaagctccagattcaaggcagaaaaaaaaatgttagtgctcttcagggataaggcagtcattcaatgtgtcttagttgtcaagtgtgaaaaagattcaaggtgccaagtatggtgcattaattcaaatgaaattgggccccaagtacttcagaaatatgacagacaagctagatatcatatcaggaaagcaaagaataaaggaaggagaataaaggctgaagccgtaatacaatgagtctatttgcaaattgagcctaaattaaggaccaagtaagagatgaagtgagaaaatgtttgcaaagtgtccgccaaatgcaatggattattagagtaattctttttaatttggtttactggtggacataacgattattgataatgtagtcaagaatatcttgtgaaataaagatgcacattctagggtaacagtccaaaacagaaacaaaaataacaccaaccaaacaaaaataagagaggcaatgtcaaatgccaaataaaatgtaaaggaataaatgaaaacatattattcatatattagcatgagcttgaaggtaatgtttcactctgagaccaattactacaaggaaggagatagaaaactggggcaataaactattttttaatagtagaaaaaggtgtgtaacacaaatataattagatgagatttatataaaccaagaaagctatttccgatgaagggctagaaaacaaagaaggtctttgaatgaagaaatggatacttcaacaaagaagtaacaagcagtatgcaaaagtttacaaagtcctgaaactttaagcaccactgactaattactgcatattgtttccacccatagggactatgtctttctgagcaagagaaaagtttttggagggcgacgacaatgtttcatccattctggtctcctcatagtctgggacaatgttctacacactggacaatgtgtccagtgagccccaggtcatgttgtctgtgtctcccggacacgctatttctatgcatttgtcttagaacacacttctcctctcttttggaataagttaaaacagacagaacagagaccatttgaaataacattcctacatctttccatcagtgcatgcacatctcctattaaaaatattcaacactcaccttctctgaatgtactttactcttatgagaactgcatttaggtgaaaatatctgctcatgtctaaaccaatccccaaacacacacacattgcacacacacacacaaactaagacaaacaaacaaaaatgaactctacttgtaaaacctgaaatttcttgaaggctcagaagttcaaaataacaatatttcaatatgtgcccctaagttgaccaattgaaaacaaaaccaagcccacacttttctaactcactaaccctttttatgcttccaacttatttcaattgtctccttacactttcttttgaaatctgcttttctttcaggtgtaaccatgggcagcctcaaagttgcagtctcaggccatctgccttagctgttcaatgtctcagttacctcattaactcccatgatctcattacgaactgtgaaaatgattcccaaagctacagcccagctctgacagctcaccctctagcaagtcccatataggcagacacttacaggaaaacttcatagatgaccctaaaactcacaaaaccttacacgctgaaatccaagttgatcttcctctcaacaaccttctcaaattgtccattgttacaaacagccttatcatattcatatcatattcaggttttgaccataagaaaatgtttgtacttcttctcttttgtcctatgcctgatcttacataacatggtaaaggggtctattttagatccttttttaaaaaagttctttgggtttcccccttttgatttttataaaattataccctcaatacctaacttctagatccctgaaacaatacacaaattggtttccttggccctgggttctctagctctagaccatctgtcttaagtcagtttcactaaatgcagaacctgagataggatttcttgttcatgtgatcaattgagggagtgctcttagaagaagagagtgaaggcagcaggatgcagctagagcaaaatactaacaaaaatatactctcaccagggactggcttgagccaatgtcacatggaagctttggagcatcaacgacaagccagctggagttggtgccaccttgagacaaagtgaccagtcatttgtaagcctttgacggtcggtatgcctgatggttgagttgtttcgcctcctagaaggttccattagccaagggcaactctccagagacaggacagctgtgggccatagccacactaagagtagctggggcctgggtgcaccagtagtggaggtcatctgggcagggcaccaactacttccccaacaccagtggttctcaaagtgtggtccccggaccagtgaagtagcatcatccagaaacttgtcagacacgcaaattcctgggctctacctcagacttactgaatcagaaactctggagtgggactggatcccaacaatttgtgtttgaacactccctccaggtgattctgatgcacactaaggcttgagaaacatggcactacaccatccaacacagaactcatgaatacttcttaagtcccaaattagtattcactgatcaagaacctgaagtaactcttatcactgcttctgtcagcaataaattccgcaggtttacaataaatgccttccatcaaattagatgccttctattcctccaaagacccatctcagcaacgcttctttctttgtaactcttcatcatcatggaatcacaggatattggaagagaacttgaaggttaattaatctagctccctcctttttgcaaatgaaacaatggaggcatccaaattgtaagcatcttaaccaagattatgcaatgggaactcgggtctccttatgtcaagtttaatgcttgttgttatacattatgccgattttactccaaattaagggtatgaagtttcaggtttgacacgatgaataagctctggtcatctattgtacagcagaatgactacagttaataataatgtattacatacatgaaaatcactaagagagtagattttaaatgttctcaccacaaaaaaaataatgtggaagatgataccatgttaattagcttaatttaatcattttccaatgtctacatatatgaaaacagcacatggtacactgtaaatttatacaatttttatttgtcaattatatatatatgttaataaagttggggagatatttttaaaattaaaataaatttaagaaaagaaaattcattacaacatagtcacagctaggtcagctctacctctttaaattggtgtttgtgtttttgcctgcaactaatatacctgcttaaccgttttttaagtctgtttccattacttccttcaggaaaccgtccatgacaggcatggtttatgatgttcctatttgtcaggtatctaccatccccttgacacttccatgagaagaatacgtttccttgccaatcaatgttggtcttggaaggcgagaccagaggaatgtgaggagctgggaggaaccctgagtgcacatggggcaaaagcacagcatttggctgggacccaaccctccttctctccattgtgaaaacaagtcccagatggagatgttcctgggatccgaactgaaaagacacatggatcagaattaaacctgaccccagcttagagtcaagcaagtctaacccagtggggccacccctggtccacagacccaggttgagatatgaatatttaaccaccattctgtatcatttgttaaacagcactgccacaacaacacatgttcacacacacagttcaaatgctggagaccaagcatgtttccatgcattggaaatacatgaactcacttaattaacaaccctatgaagtaggcgctattattaagtcaattttacaaatgaataccctaaagcaagagaagtgatgtaatctgcccaatgctgcatggctgtgatacaactagaccacccagctctgaaggtcatgctgtcctccactctgcaggtgacatttcaggcatctggacacttctgtgttcccccctcctctgggttcccagacttccataggaattcctgtagctttgcccttatctcatcatgttgaggtacaaaggttcacttgatgtatctcacctcctaggtggagaggctaaatactacctggtccacttaaagagcctgtaacaaggagttcagtaaacactggttaattgacaaactatgaagactcaaactcagctctcaggaccaagggctagtgctgatgctgtggtctcccaggcaagctcccatcttcctctatacctttcatgcatctgggggcagcacagctccatccctgtcttgactagctctcctagaccaaacactcacccagatatcacagctccccatgatctatcctcagcatatcttttccatctcctctttcatttatctcacagttcgtgctaagtcccactcaagcactccactgtctctcactcctatctgacatgaaagtccctcaactatgcatggtctattccaccctaaccacaggtgcaaacctttcccaccctcaaagcgcagcccaaacacctatcccctgggcgccccagctgaacatcctcttccctcctctgggctttaatagcacatctctgtggctttggtgtctgtgtctctaggcctatgacattgcttgtctacaaactctctatgtgtgtgcttatttctgttacttccacaagcctcttaaagctagggtccatgtcaaatccatctacattatcccaaagcacagaacacatgactttcaatttatggcaagcattcaataactatttccataatcaaaaagtgatggtaaaactggcttgcttttgtgaggtattattcactgttagcttgttctaaagggagctgggtgatggcatgcagcagaatccatcacggagggtacatcacccaccagctttccatctgcagatgttgcccattgtagagcagcatgctgcctgttcaggcactgttgccaaacagaaggttctcttggcagaagaactggcacatgctgggctctgcaggctgtgcccccgaaccagctcttccacattggcaaatgggcatccttgaaattgccctgccccatcccccacaggcctcctaccacccaaacagatgggcacacgtgtaagtatgccggggagcaagtgtgtacatcaggttggagctcctgataaaagatttgtctctcatacatggtatcaaccccgtccaaagagcaaaagcacaccactgtgaaatgggaggtgttgcaaaggaattgccttcatattctaattttgggatccattaattaaagagtcccagacctggagtgggagggggagaatgagaaagagctgaaagagaacattctgtttccctttaaagttttggctggtggcatcagtggacctggaaatgaatgttgtctcttttcaggtggagttcagatttaaggcatttttcaggagcagctaaatccacgacctgagatttctattgctgcctgcaagacagctggataaaggcagttctctcagggactagtatgcctccacacacaggtaagagtaaaagtttaataaattatctataaaccatgtttatagagagaatgatacactcaacatccaaacttattgataacctagttgcagtaatgtcagaatcgagttgaaaacctttattgactcaggttgtcttcattgtctgaaggcgcatgttggctagacaacaaagacagtggtgggagcagccaacatggcctttggtgtacattacaaatttaaaagcctaaaattgacaaagaaataataccacctataactctagagcactttaattctggtcttttttgagacactaaagacaaataagaactgcattgatccacttgatctacagatctcacaagtaatttcttctgctgggatttgtttttttttttttttcttttactttccaaactctaaaatatccatgactcatttggaacacaagaagtgcagcatgaacatcccagttggtcatctgcagaatatgccaaacagcacaggatgcggggaagccacataatggagaacagatcatcgtctggcaaagcaactgtccaatggccagcaggtggcccagttgctggaccaatatgctgcccagtactggaaggtgctcagtctcagaaatgggttataaatacccatacagggctgtgacatgtggaagctaagagccttaaagacttcaagctttgctggtcacactaggggcgtcaagtgcttctctgtagatagaatctatccagtctgtttattgtctgccttttaaaagtcactcctcatttccagacagcttcagatagaggcttgactagggattaaatatccatcattaatatggctcagagacattgaaaaagaataagagagaagagaagaagagtttaaatacctcctgtagaagggctatctcactgtgacagctctggatgtttcatttattaaacaatggaaggtatagtatattatagatgtgcttaaaaaatcatttacaaaggagaattactttatttttaatgaagaatcaagccttatcctctaggaggctttacaaaaatggttttgaagaaattaacctctaattttatttatttaaatgcatgtatttctaaagcttcaaaattattgaggtccactagttgttttttttttcaaagttactttagctagttggatgacttaactgtagatcacaagagtgtccaaacttattttcactccccagaatttttttcattctctcctgtttctgtcaggaggtcactatgttcatttgcctggtagcaggatgaatggcaaactcctggcatgtacaagttgaggaagctgcaatttgctccccctttctcttgaaggtcactaaatttaatactgtgattgaaactcagtgcctcccacaaatctccagagaactgtgattcataaggaggaagataatttggaggtgggatatgttaacctgtgcacacgtgttaagcaattataaattgtttcctttcatctgtctcagatgtaatacatagcaagactctgaagtataaatcctctttaaaatgagacagtcgggcaatagcccatgaggatacgtgggttcattcacaacactgatacccctgtacaacatcagatggtgacaaatgagactgattttcagcttggcttgacttgaactggtagcttctatctttggcttccttcttgcaggaaaaaaaaaaatatatatatatatgtctcatttagcccattggcatcattcccagtcaatgaatgagcatgacacttctcccagtaaccatctcaaagttttctagctgagctagttagtatagaaaatgttttggcactggaaaacagatgatagaaatcattgtttcacttggtgcacgggagagcagtggggaggtaggatatgcaggacaaagtagttttgactttgcctctcccagtccatgtaacctttgatatcccagaattggaatccctggatacacatgaaacacattaatgcatcacaggcaagcccaaaaattagggcttagtccaggaaggtttttggcttttcccaggaaagaattcaaaggtgagccagtggtagaagaaaacaactttattgagatggcagtgttacagcttcgtgactgctcccgcagagcagggctaccctacaggctgtgtcaagagcagcagctcaggcacagctcacagttaaaagtgagctcatggttaaactcacttttaattacatgccaattaaggggtagattattcagaaatttttggaaaaggaatggtaactttcaggacattgccatggaaaggggcagtaacttccaggtgttgtcatggaaacaggtggtaacttccaggtgttgccgtggcaatggtaaactgtcatggtgctggtgggcatgtcttatggagaggtactttgggtgcctcttccctgattcagccagtctttaatctggtccagagtcaagtcccacctcctacctcaacatgactgtatccctgaatacacaagaaacccttggcgatatctaggtcttctaattggggatgacaaggggagcatatacaggaataaacctttgctggagaaccacgcagtggctcctgatggggtgggaatgggcataaaagagatatgaggcagagtgaccaatgacagaggatcacaacaagaaaaggcacatttgagagcaattataaggtcaatgatactgagaagtgctgcacttctaaatctacctcccaataacatattggtctaaattgaaagggttcttcctgtttttaatcatacatgattttaatttaactcacacagtctccctgtactagtttgctagagctgctgtggtaaaataccaaaactagatggcttaaacaacagtgacttattgtcacacagttctgtagacaagaagtctaagatccagctgtcagcagggttggttcctttgaagactgtgagggagaatctgcttcagcctctctagcttctaaaggtttgctcgctgggatctttggtgttgcttggcttgtagacacatcaccccaacctctggctttatgtacacatgtcattcttcctgtgtgtgtctctctgtgcataaattcctttttttttttttaagaaggacaccagtcatattggattagggcctcacctgctccattgtgacttcatattaactaattacatctacaacaacctaatttccaaataaggtcacattctgagcttctgggagttaagaccccaacatgtaaatctggagggatgcaattcaacacgtaatattccctaacacaatatttccataacagtctgtagcgtcttcttcaggctaagggattggggcctcatctatcagagttgtaataaggaacaaaggttgttgaaggtaagatgagactcaagattcaataatatgttcaaactgcagaatcaaagagtatattgaggccaaatatctaaaaaagaaagtttgatggattgctaaagtaagaggatcagaaggaagtattaaaactaagataaggatacagaaagttgcaatactggatttgacataaatgtacaaaaaacagggaaggttaaataaatcgtgatacaaccatcaaaattaaagatttggtaagtattttctcatcccatgaataaaggcccattgatctttttgttgaaggatattcagcccatattaaccagggttgaagatcctacataaaaagatttgagttgccattttctcaaataataccctcagacactgactcttcataatgggttctgctagtacaactctgaaagtcttagagagaagtttattcattccattcaaaggatacttgtttcgagagcccccagctaaatttgggttctagtaccagaacagctagcaaccctgccctaatgggacatgaagggtacctggacatgggtgtttacagtgtacctttcacgggatacttcttttacttggcagacttcctaattcttacttgactgacttgcaatcagggagtccctcacataggaaacttgtttacactggcagatgcccttatggctcttatctgacccatctccagtttagtcctgcctgaccattgctcaggcactgggagcctgactttctagtctccctggcaacagggaaaatccggccaggataacctctagttctttagatggaaggtgcaaattcaatacaccatcacaataggaaataagtttaaagagtttttacttataggtcctaggcaaaggagttgacaatgagtcaagagtgaagctctccatcctcagtcatgcaggcagaaatggagtcaggcagagagagacagagagagcgtgcacacatgagtgcatgctctcagcagcatatataaaagaacagcgtatcagtcacttcaagtaattgggcaaatgcctgaatgatccctttaaagaaagcagaaggaagtgcagagctcagtctgccagactggagagagatgcctccaagtttttatctttggccactggcttgagccatttgagtatagcatggaactaaaggctgtgtcaatggtgactgagccctgcttctgatatgagaaagtcaaacttgttttcaaaatagatgctgatgcaagataaaatcataagtatttaccacaatgccttcaggtattagggcctaaggtttggttttgctttttggtttttgttttttgcttttcaatcctggttaagaagtgctaaaagatattatagccctacattctgattggtatcaagggcaaattttccttcttttacaatgtgttttctagttttttttttattttgttacaatcagcataaaggaagaaaagattatgcctttgaataagaattgtatttacattttactttttaaaaagaaggcaataacttgcatttctaacaatggtttattagaaccaaaccttcagatagaagcaactaagaatgctagataaaatatttaaaacgtctccttataagaatttaagaactgacagatagccaaaataaaatctaaggaaagctgaaatccagaaagccaagcacaagaaacttactctactttgacctgcagttacttgcctaccccgagaaattcctgctttgattctgcaatctcccttggatagcacaagatgcagaggtcaatgcccaggctgtatcccaagtggagacactaataggaggctctccttatattaagcaaggggagaaaaaaaaaggacaatgaactcatggttatagtgctacacataaactcctctctcacatctttgcaggagaatacagaggaagttgttgggccctgtctggagtaggtattaaaggaaaagaaagagtgttcctaccaaattatagacattagctacagcattgcctgggagatacagggatccacagattacaaacttgtttatggtcacccaagaccagacatacagaaacttggcagtagcaaatgcatattctctctatagagaaaattgtctattgaccttcaaaatattaccacaataaaacccttagacaataaactgcacacaaataaccaagcacacaaggaaagaaatcaccatgagtaaaatcaagaagaaacagtagaataactgaatcatacccacaagattacagtatttcaaagagatatctgcactcccatgtttattgcagcactattcacgatggtcaagatatggaataaatctaagtatccatcaacacatgaatggataaagaatatatggtatatatacacaatggaatactattcagccataaaaaggataaaatcatgccatttggctcaatggggatagaactggtggccattatgtaaagtaaaataagcccagtacagaaagacaaacattgcatgttctcactgattcatatatattaatacagaataaagtaaagtagattctatggaagcatagagtagaattgtggtaaccaaaggttgggaagggaagtgagaaggaggagatgaagagaagttggttaaggggtacaaaaatacagttagatagaagaagtacgttttagtatttgacagtacggttggagaattaaagttaacaataatattgtatatttcaaaatgcctagaagaattgcaagacaaagaaaagttaaacgtttgaaagaaaagataaatgtttaaggtgatggatatctcaattaccctgatttgattattatacattgtatgcaggtatccaaagggcaatgtaacccaaaaatgtgaacaactggtatatatggagcatcaggaagagtagctaatggatgtggagcttaataccaaggcgatgggttgatttgtgcagcaaaccaccatggttcacgtttacctgtgtagcatacctgtacatcctgcacatatacccgagcttaaaagttgaaggaaaataaataaatttaatataaatatttattttgaattctttatcaggaagtttgtatatctccatgtcttttgggtcagctactagaagattattgtgttctttgggtaggagttatgtctcgttattggttttttgtgtttcttgttgacttacattgaggtctgaacatttgaaaaagtagaggcttgttccagtctgcagactggctttgtcttgggggagcccttcaccagtcagcctacccagagattctgggtataccacctggtatggttcatgagcaggcttgctgctaatgtcctccagcaggctggcctgtttcttgggtcagcaggtgagcagaccctggtgcctgggtctgcaggtgccaacctggtgactagggccatggggggtattctagggctggggtgggcatgaagtctggggctgtaggggccatcccagtgctgggggtggtctggagcctagggctgctggggctaccctggccctagggtgggcctagagtctgaatctgtgggggctgacctggccctagggtagatccaaagccactgaggcccagtctggatcctggggctgaggcaggcctgaagactgagtctgccaggccggactggagcctggggctgcaggatccagccttggactagggtagtcctataggttcagtccagagggaccggcctggagtcttaggttatggtgagcccagtgttgggttttactgtggcaggcccagtgttggcatccaaggcaaagtgcagtgcttacttttctctcctttccccaagtgaagggtatctctctccatgccgtgctgcctgaagttgggggcagtgatgcaggtaatataaagctgtccttctcaccctccccagtgctactcataacatcaggatgaagcttacaaacaacacattgagtaaaaggagtcagacataaaagaacacattgatatgattccctcaatgttaagttcaagagcaggataatctaaactacattgtttagtgatgctttttataagagataaaaatatctttaaaaagcaatgatataattaacaaaatgtcagaacaaagattagtctctgggaggacaatatagaaggaaattgggagtctgacgaggctctgtttcttagactgaatggttgttacaggggtgctttctttaaaagtgttccttaaacaacagcttgtatagattgtatgcacttccctgtctgtataatataattcaaaataaaacaagggaaataatttgcaaaagaaaatgtctcctggatgtcttggacttagaaaataaaagcaagaattagtaggtagcagacaagctgtaagcaattttgcacagttgggtatacaaagtggtattggctgatagttttcacattccactcacggagaggtagatgggtttaatagctgtgtttaaagtgtcagatgcaagaacaatgataggtttcccttaaacgattttcactaattccctcccagctcaagaacttttttcattaaaatggtcctttgctgcctatcagaaacaattaaatcctcacctcatagcagtctccatcttacgtcaaccactccctttggcccccaaaatatacctccaatattatctaacacgaactggaattgccacatggtcaaggcaataaagaaataaagccacgaaagaaaccaaatgaaagcaaaggtataaaatgatttagatgttagtctgcagaaagaaaaagctgaaggaattagaaacagccacaggaactttctgtgaaccaggagaggcacttccatttacaaaccacactttgtttttcatagagtgggcttgatcatcacttaagaactgaaaattcagcattccttctaaggtgcattttgttcaaattgatataagtgccccagatggtttggcttatggtatcccattgattattgcgttctgctcttgcaagtcatagatctgttgtaatctaactgtctggggagtggccattattctagtttcaaacccattctgtcctcagtcacacgcattcaagcaaagtaatgcagggggaccagataaaagccgcccattagaaacctcagttgctgcttgcctctcccacagaattgaatatattactccagctatcgtcaacaaacatgcttcaacaacaggatcctcactgtttggaagacagcccctgagacccagagcaaatgggtcaaagtctcagttacatcagtataactacaaagacaataattcttacctctctcacaggatccagtgaaaaagtaagtgaataaaaatagactgaaaacagcaatgtaaggagctaaaagtactgtgtgcattgttgtaaaatattaagtcaacagtccaatcatttattgccactgaaagtctaatatcttatctgacaggttgtaaactttcagagacataagcttgaagtgtgtatgtttgtgtgttttaagtgtgaactgaagcaggtggcaataaggggaagaaggaggggaaatgggaagaaaagtaacacgaagaagaaatgcataaagaagagaccatgatccagtgggcaaataactcagttgaatctttgaagaaacaggtgtcaatgcttgttatcatggtgaaggtcaagtaacatttttctagacatttatctttactgctctctgctaggaatgacaccagcgcatcacaatactgccctcctagcctctcagcctgtgctgcctcccaccatggaggcacaccactgccattctccatttaccttccctcatctccctccccagctcaggctccttgcctcacagctcatctctccagactctgagtacatttcaaactgtctatggcaccaaataataagacaaaacaaaataggaaataacaagctaaagaatcaggtctaggaaggaagctccctttcagtcagaaccctctagtttcttgtgttacttcaggtcggctgtggatttgatgtgtaaaaggatgtgtggggaaagagagcagaaattaggaaaagccttcagcctgggatgtaggtctgatactgcggaaggagagagggatagaatattggagagcaagagtctcaaactgcaggaaaaaatggcttggccagacctatgggcagtccttaaggcaaagttacccactggagagctccatgtcatgtctcagtacccatctgtgctcagccactggatggctgcagcctgcagaaaggttggtcgcagtgaaaatgtgggagcagttaaaaagggacacaggtggggccatttgtgcttcctgcagcaagacgatctaagcagcagcccctcaagaaatatgttcctttacctattggtcacctgaaagtaagggccttttttttttgctcactccatagcatagaagttgcaaactgactgtaatggacaatctgggaagatgaggtttttttttttttttgctattgcatttgggtattgaatagtgttttaaaaacttttgagctagtgaccaatatttaaaacaaatagattttacatttttaaaattcacacttccagcttttcttgaaatgaaatgcaaagggacaacattctttcacgctggtggaaaaacagccttcccccttagtggacattcactctgcagctggccgtatttcccaccattcctttatgcctacaccagcccacgcacggatcactttactgactgttctccatgatcatttaaggctttaagtctcctgcattcatgcctgtgtcaccattagaacataatatcactgacggcaattattttgtctgtttggatcattgacaggcaattaattgcctgcaacagtacaagttacatattagctgcccaataaatatttgttcaataaaatagggtgctatcaacatagagtgttggaagaaattgagtggatggtggtggagaaaaggcacttgtttcagagtcttgtctatggttagctttgcactacccacacacaaccaaactggcacctaagggagaaggtgagactccagacacagcagtagagggtgcttgttctaaggaatatgtagaatcaaggtggtacagaatgggtgtgtatacagcagcaaaaagtctccccttgcatgtcctgtaccctctcgcaggacttctttactctcctttcaaatttaggatgagggagtgggtttgtacagagaagcagtgcttatctcagctcctgccctagccccagctcagcctgaagcattgctacaaaatactcactgggtcacattccagggcagccaggcatgaggggtcctcaccccagagctaacgcacacttaagcataatggaacgaattgagttcaatgatgatgcgatgggtgatcctcaaatggcataaaaatgcacatggacaaatattgcaaatcaaaccgagaactgctgccagaggccagtcccccgtggtgtctcaccagctctgaaaatgattaccagatgataaagcagagcaggctccctgcaatctgattacgaggagggactggcaaatccattaggagcaaacaggcctccttcaagtccattttacttgctaaaatcaagcaacgttaagtttaaaaaaaaaaatgagccaatttttcatcccattctcattgcctcatagtcagtgcattcgttttcagttaaaagagctgggaaggtttgcgctttgagagcaaaccttcctgctattaaaaatcaaagtcagacgtaagcctggcatgaagcagagagctagtacctttagtttgtgggcaacctgttctgacagcctaacctgcagaaaagcagccgtggaggaagggaagcaactctgaccttctgtgcatcagaccgcacagagccctctgcttgtgtcctgtcacataattccctattccctggataaggagatttataaagaatccactaagttagaacaggaagggattttagcacttgtgtaatctacctttctcttagtcttatttcgttttatgattattattattattttgagacagggtctggctctgtcacccagactggaatgcagtggcgtgatctcagctcactacaacctctcccccatctcttgccccctgggctcaagccatcctcccagctcagcctcccaagtagctgggaccacagacatgcaccaccacacgtacttaatttttctgtttttagtagagagagtttcttgccatgttgcccaggctggtcttgaattactgagctcaagcaatccacccgcctcagcctcccaaactgctgggattccaggcatgagccactgcgcccagccttagatttattttaaaaccacatcatcttttaataagcataaaaaatgttcatgtcctcgaaagatcttgacatggctggctccagctctaccccacctctagcttgagagtctttttcttgtacacttccagtagccaacaggtttcagagctttgtattccatagagtacatgatggaaacaatgaaccattttccctgaaatatgaaaatataatatcatattaaatatgctttgaaactaaacacttccctctaccaccatcaccacctatcaagattctgatacaggcttcgctgacttggtttggccctctcatgttatacagaaagcggctgagacccaaagatttttttttttttttttttttgagatggagtctcgctctatcgcccagactggagtgcagtagcgtgatgatctcggctcactgcaaagctctgcctcctgggttcacgccattctcctgcctcagcctaccgagtagctgggacgtgggctcccaccaacacgtctaattttttgtatttttagtagagatggggtttcactgtgttagccaggatggtctcgatctcctgacctcgtgatctgcccccttggcctcccatagtgtttggattacgggcgtgagccaccgcacctagccaggcccaaagattattactgacctgaggctgcagacttgcttttcttcctaatgctggaacctaaccccgtgttccctgactcacattagattgctctctcagtgctcagggctttatactccaaacccagggcttcatacatgactgcccaagaacaagaggaaattgtgaaaagtgtctttgaagaggatcatataaacagtaatcttttgtattggcatcatttggatagtggtgttgggacccaagggtgaacacacccctccccttcaaaagttctggtcaataaagaacactcagaggacagtgctccttgggacagttacccaagtaaagttcaggtctgtactcaactaatggctaagcaattctccaataaccaccagaggatagggctctcgggtgaaagctagattagaaaatatgacctagagcttagaccaaacatgatttttaaattctgaacactactcctgctatgcccataactgaatacaagtaggccaacaaaacaaaagaatggctacttcttctggggttgggaagagggagccctgtcctgctctgctttcctcaatggagcagaagctaagtgcatatttcttcttgaacacacacctgagaagcagtcaagaggccctgctgtgcctgagtgtggtctacctatgcgtaagaggtggaggaaagagatggaacatgttcatgccaactttcccacccgataggaagaggtaactttagcagaagtttcccatctcttcttagaaggtaaagtagcctggccgggtgcagtggctcatgcctgtaatcccagcactttgggaggctgagacaggcgggtctcttgaggtcagaagtttgagaccagactggccaacacggtgaaacaccatctctctcaaaactacaaaaaaaaaattagctgggcatggtggcatgcacctgtagtcccagctacccaggaggctgatgcaggagaatcactggaaccggggagatggaggttgcagtgagccaagatcgcgccacttcactccagcctgggtgacaagagctagactccactcaaaaaaaaaaaaaagaaggtgaagtagcctatcaccataggctacttcatatgatgatagagtgctctatcatcatccagttcccatacacaaaaaattaaacccattaatggaatggtaaaaagtacattctttattgaaccagaaactgaggaattccagagattggaagtgacagggtacagctagagaaggagacttcagcctgtggcatgcaggaagaccctctggaaagggagacagaggccacaaactgccccataaccaagcgagggcactagcttaaggctgtgatcacaaggccaccagcaagtggtggtgactcagcaagctggatggttgacctcctcatatcttctttcttccttgggtcagggagcattacaggaataaacacgtccatacgggtggatgaaataaaagcaggagttggaccagagataagtgattatggaggctgtcagaggatcactctggctgctgagtggagaacagtttatatgaggtgtggagggggagcaaggaagccagtgggtgtggctgcagtctttcaggagatggagctaatggtgtcctggatgagggtatgaatgaaggaatggagagaaggacacaaattctagtgatatccaggatgtaaaatcaacaagacaaagtcatgggtcaagtatgattttgtatcccactatgcctatggattcacaatacaatgaccttagtacacttccactctatttactcatcccttataatttttgctcttcttctcatgtttgtagtgataatgtatgttaaacatctcaatgcattatttttgatgtttttatagtcactattcatttcatttccattttctgttggtcttcctttcagcattctgtgtttttacctgggatcactttcctctgaactgaagaactccctttgctgttttctttaacacaaatgggctcctgaaaagttctcttagttttgacttttctgaaagtatttcttttatttccactttgcttttgaagaatgttttgctaattaaagtaaaattctaggttcacagttattttcttatatcactttaacgagattattcaattgtgttttgactctcattgtttcccatcacaagtcagttgtcactcttcctgtttcctttcaaagtcatctgccttttcaacacttctggctcctttcaggatctccttttgtgtttggtgttcaaaaatgacagtgatatgctaaagcatggttttctttgtatttatcctgctgaggctcataggccatgattttgagtcttaatgtcctcccaaaatcttgaaaaatacttgcctatgattatgtttctgttcattttctttctcctctctttctggaactacaattatacctgaaattcaatcttttcattatgacccatatatctcttacttactcttctatacattgagactttttatctctctgtgttttttaatatctctctggacatattctacagactttcttccagtttactaattctctctactaccctaccatgatgcccattgattgaaatctcaatttcatttatttttatttttccattataggatttccattggaatttttatggtttctggttctctgctgaaatccttcatcttgtaattgtatttcttgaacatcttaattgcgagtatttaatatccatgtacaataactccaatttctaattgtctatgggtctgtttttactatctgtatttctcttgtttttggacaaaccttatttttttgtacacctgttttattttcaaacacaacattgtcaaatgttgtataaaaaatgtagagacaatttaagactttgaataaggttatcactctccagagagaaactaatttttcctctggcaaatcactttttttccgtctgggactgagctgattagaagttgtttttcagtctttctgaggaatggcatgtttccagttcacccttactcataggatataggccttaagcataacaaccaaaaacctgcagtaatcacaggacttctccttagaaggtcattcactacaatttttgtccctctatccttgtgagactacaaagaactttgcttataatcttaacttctcagatgtcatttttgttttctgattttgcacttgccttctaggcaaaagcagctccaaatgccagacacctctctttgtttccctcttttttctgtatcttagccccagaaatgctcattgcctgagcagctctttgaagccttcaaatatgtgtctatacctgtgtgtatgtatgttctatattttctcattattcttcctgaatccaaaaccacgtggtcagccaaaaacagaaaggggcaaaagatgatgcatgggtttgtttctgacttgcttaatagattttataataatgacattcaccattacagggaattccagaaaaggactgactgctgacaagattggttcttggctggcatctgggaacttacatttcaggagggtttctgctgttaactgataagcaccattcaccgagccaaaagtatctgtgaaaagaattggtttttgttgaactcctgctttcctgctgggaatctgaaattgcatacatgccagacacagaggggatatatattagtccactctcatgctgctaataaagacatatcccagaccaggtaatttataaaggaaagaggtttaattgactcacagttcggcatggctggggaggcctcacaatcatggtggaaggcaaagaaagagcaaaggaatgtcttaaatggtggcaggaaagagtgtatgcaagggatctgctctttataaaaccatcagatctcatgagacttattcactgtcacaagaacagcatgggagaacctgcccccatgattcaattacttcccactaagtcccttccatgacacattggggaatgtgggagctgaaattcaagatgagatttgggtggggacacagccaaaccatatgattctgttcctggcccctcccaaatcttatgccctcacatttcgaaaccaatcatgccttcccagcagtcctccaaagtcttaactcatttcaacattaactcaaaagtccgcagtccaaagtctcatctaagacaagtcaagtcccttccaactatgagcctgtaaaatcaaaaacaagttatttacttcctacatacaatggggatacaagcattgggtaaatatgcccatgctaaatgggagaaattggcaaaaacaaaggagctacaggccccatgcaagtgtgaaatccagcagggcagtcaaatctcaaagctccaaaatgatctcctttgactccatgtctcacatccaggtcattctgatgcaagaagtgggctccaaggccttggggagctccactcctgtggcttaatagggtatagaccccctactggctgctttcacaggctggcattgtttgcagcttttccaggtgcatggtgcaagctgttggtggatctaccattctggggtttggaagatggaggtctcttctcacagctccactaggcagtgctccagtggggactctgtgtaggggctctaaccccacatttcccttccacactgctctagcagagattctccatgagggccctgcccctgaagcaaacttctgcctggacatccagacatttccatacatcctctgaaatctaggttccgaatcctcaattcttgacttctgtgcactctcaaattcaacaccacgtggaagctgttaaggcttgggtctggaactctctgaagccacagcctgagctgtaccttggccccttttagccacagctggagtggctaggatgcaaagtaccaagttcctaggttgcacacagcaggggggccctgggcctggcccaggaagccatttttccctcctagtcctcagagcctgtgatgggagggacttccatgaaggtctctgacatgctttggagacattttccccattttcttggtgactaacatttggctcctcattatttatgcaaatttttgcaggtggcttgaatttctccccagaaaatggggttttcttttctattgcatcattaggctgcaaaatttccaaacctttatgctctgcttcctcttcaagctttgccacttagaattttcctctgctgcataccctaaattatctctctcaggttcgaagtttcacagatctctagggcaggggcaaaatgccaccagtctctttgcctagctatagtgaccttttctccagttcccaggaagttcttcatctccatttgagaccacctcagcctggactttattgtccatatcactatctgcattttggtcaaagccattcaataagtctctaggaagttcaaaactttcccacatcttcctgttttctgagccctccaagtctctaggaagttccaaactttcccacattttcctatcttcttctgagccctccaaactgttccaacctctgcctgttacccagttccaaagtcacttccacaattttgggtatctttacagcagcgttcaactctctgcagtatcaatttactgtattagtccattctcatgctgctaataaagacatacccaagactgggtaatttataaaggaaagagatttaattgactcaaagtttagcatggctggggaggcctcacaatcatggcaaaaggcgaaggaagagcaaaggcatggtggcaggcaagagagtatgtgcagtgaactgccctttataaaacaaaaccatcagatctcatgaaacttattcactttcatgagaacagcacaggaaaaccaattcccatgattcaattacctcccaccaggtcattcccacgacatgtggagattatgagagctacaattcaagatgagattagggtggagacatagccaaactatatcagagtacctatgtgatcagcccccaataaaaatcctgagcagcaaggctctaataagcttcaataattgatgtttcagatgtattatcataattcattgctgaggtaattaagtgcatcctgtgtgactccactgggactagattgttgaaagtttgcacctggtttccccatgactttgccctatgtgccttttctctttgctaattgtggttggtatcctttttctgtaataaatcatagccatgagtatgactatatgctgaatcttgtgagtttttctagtgaatcatcaaacctgagcgtgatctttgggatttctcaagatagaacaactagagtggagaaaataataaatttagacttggacatattaagtactctttatattacttgaccttttatttatttgttgttttaccatgtacttctttagttctcaatctttcaacagcattagcatggttgaccacccatccttctggaaacatgactaagcctttttataacagagctatcacctggtttacttcttacctctcttcctctgactcccttgcaagtgcatgactttagattcttgggctgtcttctattctcactctgttctctctatattggtactttcatccacattcacagcttccaacacctcctacgtacaaaggattcacacatttacagctttggccttggtctcccttttaggctccataactgcatctcaacagcctatttatcttccagataggccagagtaacctcagattcttggtcatgccggcattcttataaaatatcaaaacaagtgctttgtttcagagcaccttctctttcctcacacttttcttctaccctcccatgaaaaggtatacatcctttgtctctgtagtcttagctgtcacatggtatgtctcctccctgtctatatcctttgatttaataggttcatccaataagactttattgaacatctactatgtacattaggctagacactggggatacaaagatggttaaaacatggacccactcttcaaagacttataggcaaataaataatggcaaacatagaaataaagtaccataaagtattataaatgtgattgcagagcagtatcaggacataatacgagcccccaaaagggtaagtagtccaatcccccagaaaatggaggaggagatgctggaactgcattttgaaagccaagtaggtgttctccatatggataggatgaatgagaggatcaaatgcacactgcagggagggacacatcatagtcactatgatgatggaaatccacaagagaaaatgtcatgaaagcaaactaaactaacttaaaatgcaaggtagtaattttctcaaaatagcatttatttgaaaacataagtaccagaagaatataagagatttaaaaaaagaactagcattttctacagttttgttacataatgcagggtttgaatcacctaggctctggatcagcctgtctctgttagatctcatgagaccagctggtgttgcccttcctgtcaataacagcaaaagacaagaaccaaggtcagtctccagggcacaatcaggagaatgtgagcaaaagggattatcagaggaaatcttaaaaaggagagaattggattaagaaagccaatgaaagatccaagttgaaagggcaggatcacctccccagacaattctagatgattacaggcaagatagactaccagtttgactatgtcctttccaagcttggcgagaaaacagttgtcatttcagaggctggctgcattcatataagcatcatattttcctgtagccaatgccataattactattcacaggaagatttggatgatgaatgacttcctggtaccacccaaatcatgccacagtgtccactctgtctgatccaattgtcatccctggacacagacgtaaagccctcagccctggctcgccagagcaatcacagagtttctccttgtcctccccaactgcacacactcggatgggggaagcctgttcaccaagagcaacagtatctacaggaggaattttaccccagatttttctctcttcatgcataaaaaggtgccatctgaaattatctcatctgtccaaaatggtgcccagacaaggggagaacagtccattgatagctgtcattcagttcaataactgtcaagcctttttttatgaataaggggctgcactagttgccattgagcattttaatatatacaagaaatgccctgtccaaatcagaatacaccctgggaaatggacaattcaacccaagtgtcataatttacctattgctagcaaacacaatgatcaaagggtacaactctgatatggacatatgcccagggcagaaaaagaaaatcaacagaaacaaattgattgcaaataatcttgattcattgctaatttcaaaagtgtagattttattacataataaagttatatatgggcataaatattctattatatagttttatctctagatcaaaaaagtaactttatttatgtatacatatttttgctcccaggcttataaacttttgcttttatggtatggtggtcttaaaaattaaagcaaaatattatctgcaatgtttcccaaaagtttccgtgtgattcagagagctcaacaatgatgcaacagcaggcatatagacatagcaatgcaattcacacccagctatttaactttttattttctagactgttatgattggctggattggaggatgaattctccagagcagttcacaccaacaaagagagaatcatatctgtagccacagcttctaatttttataattattttccccttttaaaaaaacccctttgcttaagccagtgcaaaaaaagtaattcaaaaatcaaactatttattataatcactgtccacccatcactctgggtagccagaatgagtgcgctggaaatagatatttaattagatatttccaaacagccctcacaccttttactttccactgcccttacaataactctgggatttttaaaatctaaaattggaatatgatacatgaatgtaagtaaatatagatatgcccagaaattaaattgcacctgtgaatttatcctacccttgggctactaaccaaagattctttaggtagattaatagtttaactctagcacatgaagaaatgatattttaattaagtttggggaaataatatatgcaggcaaaagataataaccatactctgtcaggtataactacattgacttgaagaaacagtgcatgtaatcctaaaattcgccagtgccctgtaatcattaatttttccattaattacattaatcattaatctgtcagacatgctctggcctaataataattgcaatcatttttttgaggatttagggtgcattagaaatggttctgagaacttcacaggcagacatcaccactcaggtaatcttcacaacaacctggtgagggagagctattttgattttccttttacatatgaggaaacaaagaattaaagaggctaaataacatgtcctgagtttaaacctaaccagtggaggtcctggtgtctgcatgggtgcttgctgctgagacccaggcccccacgctgcactaggctggcgctgtccactgacgtcctcccctggcttctctcggtaggatattctccctctctacgacgggccctggggaccccagactgacagtgctaaaaggctccctgtagagttcatggaaccccaagcatctggtctgatttctcctggccccacacaggggtgccccatatgaggagagcagaagaaaccactggaagaccaggcctttttttttttttttaacctcttctcgtattgcacagaatatttcaaatatttgaaatgtcaccaaaattcccatatcaacctaattcacaacagcaactgtgataaaaccaaagtatcttacatcctgagtgggagattaggaatagaaggaggagaaataaaaaagggaggggacgctgggctcggtggctcacacctgtaatcctagcactttgggaggccgaggcaggtggattgtctgagcttaggaattcaagaccagcctgggcaacatggtgaaaccccgtctctactaaaatacaaaagaaattagccggtagtggtggcctgcacttgtagtcccggctactcaggaagctgaggcaggagaattgcttgaaccctggaggcggaggttgcagtgagcggagattgagccattgcattccagcctgggcaacagagtgagactctgtctcggggaaaaaaaaaaaaaggaggggagggaagaggacggggaaaaaaagaaaagaaaaggggagggtaggggagggggagacagaaagaaaagagagagagagagagaggaagaaaaagagagagaggaaggaagaaaggaaggaagggagggagggaggaagagaaagaaagaaagacaaagtactacatggagtgagttggagtttattttaggacatcaaatatatctttacaaattgaaaaaattattgcaaaagcaaaatatacaacataaaattttataatgcattttctctacatgcaatattttaaactatatcctttatttttcctggcttggtggcagaaatttgccaacaacttttctttggaagaactgctctcgcttgagattatttctgtgctactttggttttcaaaactcctttattttataaaattatagaaatagtaggtggtgctagttttattgtttgctttcaatgtcctatatggcaaaggaagatgttagcaatcaggaaaaactgttggtatggttgtcttttgaaaaatgtgtagatcctaaaagtctagaaattcctgcattattcttcagggattccttagcatcttccccctccagccaagactcagggatcctatttcattttctgggtaagagtggaatcccaaagttttactaagagctcactctgctatctccttcaggtggcaagacattgctgccacagggcttttatatttaattatttttattcctgatccatagttttagtatgactcatgttaggtgtgaatccccgcgctacaggtctttcttgatacagaggtgaaagtcccagacttggagccccaagtcctgggtagagatgccacctccactctgtctgagcaataactccatctctttcaacccatctttttccttttctcagtcaagaagaaagatctttgtagaccacatggtgacctcccctttgcctcaatcccatcaacttctggtctttaagccaaaccaattgattttaaacttcccccaaaagtaatgcagatggacatcatccctcagacctgggtttatgggcattcttataataagggtccttctgaaacctcttcttgtgtgcttagggagcccccataaaagagatatggctcttctctgattctgtgaagtctcaacagggattgaaattaaataaaatctactgtgtgcaacagggtactgacagacttcatggaagagagaggaattctcaaaattaggaggcagctaggcatcatttccctcctccatttgattgcaaactcaaatgactttgggaaccaggcagggaaaatcaatgagggagcgggcaggagccaacaggggagtggtcgggaatgtggtggggaactggaaagggtatgtcctacctacagacattcatattcaaatatttttacaactcagcaccagccaagtcaaataaggctgccagctgaattcagctcctgtgcttccatcttgcaacttcaggtttagactagaaaaagaaagagtcttggagtcttgtctggggagacagacatttatgagcttggtccaacctgtgccatatgaaaggaacagcatgcagacactcacagcagtgaaacagccatgcggatctgtgttcccacaggttcatcacacagtacgaaatcccacagcctccccgacaaacctgttttgggtttggtcagggagaagggagatctggtgcactactggccagcattgaccattctgctgaaatccccatggagttaccacaactcaatggctcagatgtgtggctgcgctcgaatgggaggagggatgtgtgggaaagtgggttatgaggattccccaaaagtgagcagcatctccctccgagtaggttagaagcaggaggttacagtgattggcataaactggacaaatacagtgagtcctgtggggagacaccttggtgagtcccggaaaaagtgctcatgaacttctttggaaagggtttaatctcttaggtgctttctcaatgacctctggagactgtcctatttaatacctaagatcaacctcttcatttctgcattgtaactcccactttgccccatgtcttcagagaagacatctacatacccaactatggtagagactggaaacttaggccaggccttgccccacctccagagtggtgtcctctcctagcatctgcagcccaggagggacaggagaagtctggtagcccctgaagagcagaaacagctccagaaggatgagggcctggaactcacgagcccagctacatgtttcaggaagctgacccctgacaacaaatggaggaggaaaggacgacaaaccaaaaaaaaaaaaaaagtttgaaaggtttaaatatgtagcaatgtcccaaaagggcaaccaacacggtggctgcattcagaggacacgtgaggcatggcttagagtagaacccaaagacgattcctgagcttgcttctttatagtgtcattaaaataggaattccaggtctttctgcctcctttccccctagttatgactgttgaaggccacaattgttctcttgcgaatttggctagaaaactcatccttcacagaagccacatgaaacattttgtctaatcctaaagcaaaatctgtcatacccgagaagcacagtctttctcccattctgtttgtaatgaacattgcctttgctggtggggtttttaaaaaatattattattaaataaaaccttgccaaatgtattttgcagaagtatcttttatggaaaacagatggaaagagctaacctaaaaatgcaaatcgtaacattataatgacttcttaattttaaaaattatgaatacgacttcccaggagggactaaaagagacagtgacaacagctgcagaagaaacatcaggagtgggaggggactgcaaggccaaaaaggttgtctagttgcagagattacaaagaacattccttgtctttaaatgcagtgtgctgagcactcacgtgttcgattccaaagtgtttattcaggtaaacgaaaggaatgaagaaaccaccaatactcaagatgcaggttgctccccaaagtgtctacacatgccacaaggaatataaagttctagaaaaacacacttaatgtgtttcctccccactttcttcatggatcatcagacaggaatatgaaaccacagtttgcaaatgcttctgattcgtgtatgattactcaggtgttaaactcctcctgaaatgggcatttaacacagaggttccttatattttcacaactggcctctcttgaaacccactcttcaagaagattgaatgtttatgcattttcttattttttagaaagtggatgggttttctccccaaaccatgttttccactcttgaataacccaccgtcttcttccttccatctttctccttcttcctttccagaaaaagaagagattttagaaaactctttctatatggaaaggaaggagaaatattttcaagattttctagcagcaaattttaatattgcccctgtgaatgaaattcaatacacatacaaattatgcctctttctccccttcaattctttatactttttgaatagcaagtcaccaaaggtactcaaatacacacatgcagtctcccaattaatacatttagaagtaaatccaagaagcaatctgtcatcaattgtagtaacatactgtctccaatatgctgctctgggcttcctggcccatgccatatcagagtattaagtgctgtctctgggtaaatggttgactcacacgtgttctgagcggctctcatctcaacagagccgagagaaattaaacagctggaagcattttcaaatttctgtctgcgaactgcttaatgtatcagaactcaacatggatttcccactgagacagaagtgtaaaagttgttctttcttcttcctcttcttttttttgaaggcatctcctttcctttcacaaacagaatatcaagcttttcaagttctcaccataggttagagaaaagaaaaggagtcttaaaatcagtgatcacctcctactggagaaattgatcaaaatctcactggggaagaaagtagtggaggaagacagaaatggggttgtagctactatttctctctcctagaattaaacataatccactaggactggctccactgaaagcattttgactgctatgtgtggagaccatgagtcatttgggggctctcaatgaattcatgggttcagaaaacaaacacagtcacctcaacataatataatactattcagcagagaataaaatgcaatataaaatggttcatcttgaacaccatccagggtgttttgttgttgaagtaccaagaagtccctcaatatttctctgccttagtggagtaccgtatttccttttagattctcctccccacacttagcacccccgcccaggactgtgtcatagagtatagttccaggaggattcatcctgatcatctgattgctttccctcactagagccttgggctagttaccagattcagcattcacgagcattcaaacagaattggacatccagcaaatagaatctgacagcatttggaagtgaaccacgaacgcttgtatctaagcagcagctgtctgattacttagatgatatgattcttctaaaagttctctgtctttagtttggggttgtttttacttaggccatatggtcacttcatttttcttggtttgcagctataacaattacagtgagctccaaacgtagtaatcatgtatggggagagacaaggaggtcagctgggcttcctccaaatgcagtttgagagaagctttcagaatctagaggcatccatcaacatctttcatacacaagaataaaattgtacaaaactgtgtggatgttgtaggaactgtgtcaactaagctgagctaaaagcacatttcccagaattcccttccctgtgtggtcctgagtgagtgctggccacaagggatgttttgtatgaggtttggagtgcagacataaagaagcaactctatctccttccaccctgaaggccagtgagtgcagggtgccaggcactacagagttcacgcctaccatcactaacttccagcctcccagaaggtgtaatggagtgctcaaacctgcagctccttcagtttccacagcagggctgggactatggtgaggcaggtgaggaacttgccttggggcatgacaattaaagaggcacttagtagtcaaggcaaatattttaatgcaatgttctttaaaaatcaaagttaatgcagaaatacacatggtgaacaaactatcaacatatttaatacacaggaacagttacagttctgggatgaaccatattggagctagaagcaagaggaaaaattaataacactaatctcacaggtctgtgatctccttcttcagtttctctgatccctgggtgtcaggaacacatgcatttccatgatcaagggcacctgcctctcctgcaggttgcccacatggaggtggtgagggacatctgcaagctccagtttgccctcttgggatccagttcttctcgtggatcccagtttgtccatacttctccggacatctagctgtcctttccaactatcattctggtagacctatagcaacctcatgctcagccctcgacgcaagacaacaatcagcataggcagctccagcagcacccacatttgcaaggcctaattttaatttttataataacccccatactttatacacttgttgtggttctacttctctgacccataaagatgcctgacccatagagatgtgatgattatatgcaaactagaatataccaatgaggcatcaaacacaaattttgtgagaggtacgatcaaattgtatggtgaaatgtctacagctttcccccagcctgtttgaaccatcattttaccattgtcaagatgttgccttgtgttcctttgctaaatgactagaggctgggttggcagtggggtcaattgtttataattgataagagaacagataaccaggctatccttatgtttctgtgaggacagagatgttcccctgcagggtttgcttgattttcctttatcagcaataaagacaaggttacaagcccctgaagaagccatagagtatgcttaacatactcgagttctacaaacccaaaccccattgaaggaattttaaacactattgtgtttaaaagcaccagttgctaagttcagtcatacataaactatacgtaaagaggaaaaatatttacctctttaaggaccctggtaaaagtcctaggttatagattagtctctgagtaatcttctattgttatgctgagctctggagctggctaaactggagagtgaggctctcacacagtctctggggaagacacctgcttcctaaggaattttggctcagtttggatgaactatggtacatcagaaggagaaagaatttgttcctgaggcttcctaggagaatagctgggccatagagatgaaaacctaagtacagttaaacctaagattaacaactgcactgttcaaggaaccattctctgtcgtagatctagaccatggtttctcaatatcaacactattgacactgttgtgaaataattcttagttatagaggggctgtccttcacatttctgaatgctcagcagcatccctatcctctatcatgtagatgacaagagcaccaccagttgtgacaaccaaaaatgtctccaggcatttccaaatgactcctggacagcaaaagtgtccccagtgagaatagccatgtagacaacaacagacgctgggatactaattactaaaggcaaaagcagggacaaatcaatgtcagatattgggagatcagagttagataagaatgaatcttggtagacaaagtaaggcagaattgtagacaagaagaagcccaaaaccaagtcaataaccagagatgccatataccagataaaagtcatgtcagccatccctcctcactgggtggggcctcgctgcaggaatttcagcaactccagccaggggtttagggacagaactctgatgtccctgggactgagcccctggggaggaggaggagccacagtctccgtggatcagcagacttagtctttcccactgctggctctgagggatccaggcagtctggacaaataggattcccccagtgcagcataatccttccaccaaggggcagccagagtgccccaaagtggggcaacttcagcagtctcaggatacaaaatcaatgtgcaaaagtcacaagcattcctatatacaagcagtagacaaacagagagccaaatcatgaatgaactcccattcacaattaatacaaagagaataaaatacctaggaacacagggaatacagctaacaagggaagcgaaggacctcttcaagaactacaaaccaccactcaagaaagtcagagagaacacaaacaaatggaaaaacattccatgctcatgaacagaaagaatcaatatcatgaaaatggccatagtgcccaagtaatttatagattcaatgctattcccattaaacaaccattgacattcctcacagaattagaaaaaaactacttaaaagttaataaggaatgaaaaaaggcccatatagccaagacaatcctaagcaaagagaacaaagctggaagtatcatgtgacccaacttcaaactatattacaaggctacagtaaccaaaacagtatggtactggtacaaaaatagacacatagaccaatggaacagaatagagatctcataaataagaccacacatctacaatcaccttatcttcaacaaacctgacaaaaacaagcaatgaagaaaggatttcctatttaataaatgatgctgggagaactggctagccatatgcagaaaattgaaactgggccccttccttataacttacacaaaaattaactcaagatggattaaagacttaaatgtaaaacccaaaactataaaaaccttagaagaaaatctgggcaataccattcaggacataggcataggcaaagattttgtgacaaaaacatcaaaagcaattgcaacaaaagtgaaaattgacaaacagaatctaattaaactaaagagcttctgcacagcaaaagaaactattatcagagtgaacagacaacctacagaatgggagaaaatttttgcaatctatccatctgataaaggtctaatgtccagaatgtacaagatgcttaaatttacaagaaaaagacaaccccattaaaaagtggccaaaggacatgaacagacacttctcaaaagaagacatttatgtggccatcaaacatatgaaaaaaagctcaacatcagtgatcattagagaaatgcaaatcaaaaccacaatgagatagtatctcgtgccagtcagatgattattaaaaagtcaagaaatggctgggcgcagtggctcatggctgtaatcccagcattttgggaggccaaggcggggatcacttgaggccagtaattcaagaccagctaggccaacatggtgaaaccccatctctaataaaaatacaaaaattagctggacatggtggcaggtgcctgtaatcccagctacttggaaacctgaggcacgagaattgcttgaactccagaggtggaggttgcagtgagccgagatcatgccactgcactccagcctaggtgacagagcaaaactcttgtctcaaaaaatataaataaattaattaataaataaatagtcaagaaacaacagatgctagtgaggctgtggagaaataggaacgcttttacactgttggtgagattgtaaattagtttaaccattgtggaagatggtgttgttattcctcaaagacctggaaccagaaatatcacttgactcaggaatcccattactaggtatatacccaaaggaatataggaatataaaccattctatttaattattattctcaaaggaataaaggaatataaatcattctattaaaaagacacatgcatgcatatgttcattgcagcactattcacaatagtgaagacattggatcatcccaaacacccatcaatgatagactagataaagaaagtatggtacatatataccacgaaatactaggtagccataaaaaggaacaagatcatgtgctttgcagggacatggatggagctggaagccattatcctcagcaaagtaatgcaggaacagaaaaccaaacaccacatgttctcacttataagtgggagctgaacaatgagaacgtgtgggcacaaggaggggaatgacacacactggggcctgtccggggtacagggggagggagagcatcaggaagaatagctaatgcatcctgggcttaatacctaggtgatgggttgataagtgtggcaaaacaccatggcacacatttacctgtgtaacaaagctgcacatcctgcatatgtatcctggaacataaaatttaaaaaaataaataaataaaaataaaagtcaggttagaagtcgaagggaagtcaggctcaaatgaggggaaaacaagatgaccaacctggagaacctggaagcatacatggatttcgtacacatcaagaatttggtaacagttattggagagtttgagcacctgaggaatatatcactaatatttaaaggtaagacaaagattctcagtctttccagataaaattgattttatcagttagctattgatatgtaacaagcttcaccgagaattcagtggcttaagcagtgagcttttttatttttcctgagtctatgggtctgctgggagatcttctggttctggttgggctcacacatgcatctacgatcagctgtgggtccagtggccagctctgaggctctgagccaggctttctcaagtactttgggtaaatatcacagaatacaaatttacaatactatcctagtccattttcggctgcaaaacagaataccgcaaagtgggtaatttataatgaatagaactttgtttggctcacagttctggaggctaggcagtccagaggcacagcacctgcatctgttcagccatcttgtgaggaccttcctgttgcatcttcccttagtggaaaggagaaaacagaaggacaagtaaacatgggagacagtgagaaaatcgggctgaacccattcttttatcaagaaactactcctgtgataactaacacactcccaggataacatcattaatcccttcatgacagtggagtcctcattgcctaaacatcccttaaagtccccccttcttagggccaggcgtggtggctcatgcctgtaatcccagcactttgggaggcggaggtgggtggatcatgaggtcaggagatcgagaccatcctggctaacacaagaaaccctgtctctactaaaaacacaaaaaattagctgggtgtggtggtgggcgcctgtaatcccagctactcgggaggctgagggaggagaatggcatgaacccaggaggcagaggttgcagtgagtggagatcgtgccactgtactccagcctgggcaacagagtgagactctgacttaaaaaaaaaaaaaaaaaaaaagtccccacctcttaatactttacaatcacaattaaatttcaacatgagttttggaggagacaatcaaaccacagcagataccttttgatcttaactgctacattataaaacacaagttactattatttattactaaagtagcaatctatgggaagtataatggttagattctgtctgtattgtcaccccaaccattattatgctgtcagaatagccagcaacagcagtcactcttggcaacactaatttattcctctcagttaataactcttatttaaatgttagcttcaaaataactttgacctttttctaggaactagctgtttgtccaaaaataatcatctctttttatatacttccttttgcctaaattgtactttttgttgtcacataaactcctgtgattcaaaatgttcttactttctaaattgacattcactctcagtcttaaattaatatttcagcaaatgtaacaatagaacaaagcactagcatttactgagtgtctactatgtaccaggcactgtcttaggtgctatacataaactaactctttcaatctgcacagtaaccattttctgtagacaaagaaactagggtacccaaaggataagtgactcgcccaaggtcactcagccaatacatgagctgggattcaaaccccagtagtctgacctagaacccatgtttctaatcaatacactattgcctctgtaatgttgaataaattatagcaatacaatttttattttttaataattattatgaagttatgatttctttattaatggaaagttaaatataagtacagccatgtggttaaaaaatagaagatttgtgatcacttagaaattcaaagactgctgacttggctaatcagagagaatattaattcctttcatttgccttatacagctatcactgtaggcaaaatacaaattatttagtgtaatggaatccaatctctagctataataaaccataactttgtttctgcaacattgctctaattgactctgatcaaacatttttcagttatgtggtgttgttaagcttggaagttttaacaaattgaactaaaaatgatataagtcaggggggaaaaagaagctaaagtatgagaagctacagtttttatcaatagttccataccagcatctaattaagatgcaaaattatcctttaaaagaatgagttaatcaattaaaaattaatgtgggaggtgaacaacggccactgagtcagaaagttgggtgtggggagaatacatggcagcaaattaacttttgagagaaggaaagtgtttgtgtgataaatgcatataaaaatataaaacatatataaaaaaacaaaactcgcacagtgatcatttgaaaactcatttgcaaataaatgagaaaaaatatttgggggaagaaacttcaataaaattattagcaccatcaaagaaatggtttttcatagagaaaggatattaagaaaactgagggtggtgcatatactgttacaagcttcaaatatgatttttttatataattctttttttttttttttggagacggagtcttgctctgccacccaggctggagtgcagtggcacgatcttggctcactgcaacctccacctcccaggttcaagcaattctcctgccttaacctcccaagtagctgggactacaggtgcatgctgccaagcccagctaattttttgtattttagtagagacggggtttcaccgtgttgcccaggctggtctggaacttctgagctcaggcaattcaccggcctcagcctcccaaagtgctgggattacaggtgtgagccactgcgcccagcattttttttttttttttttttttgagacgagtctcactctgtcgcccaggctgaagtgtagtggtgcaatcgtggctcactgcaaactccacctctggggtccaagcaatcctgcctcagcccccctagtagctaggattacagttgcccaccaccatgcccagataatttttttgtatttttagtagagacggggttttgccacattgaccaggctggtctccaactcctgacctcagatgatccgcccacctcggcctctcaaagtgctgggattacagatgtgagccaccgttcccagtctatttttatataattgttaaaacaagcttctattacagtttaacacctatatgaagacataaatactatctatacatttcaatgcgtaatcagaaagtggtgggaggagagtgaggatcaaaaaactgtctattgggtactatgcttattaccttggggataaataatctgtacaccaaacccccaagacatgcaattaacctacataaccaacctgcacatgtatccctgaacctgaaataaaagttaaaaataataataaactggaacatctacgtaaccatcaccaaaggtaatggcgatggcccttaacaccacagcacagcttgaccaccgccactggaatgttctcatccttgtcttttggtacaacatatacccatttcttttgggaatggaattgctggagcataaaaaataatatgtgtagtcacttacatggagactaccaaagtgttttccaaagcaattgtacccatttatactctatccacagaatctgagtctctgttgcccttattcagatgtcattttgattttaactaaatgacaacttgatcacaccacatagtaataatcatatgcagttattaattatattgatctttgacatcatctattcaccaactggtatgaaagtatttcatattataacaacctatacaaccatattagtgcaaagttgctgaatataagccttgtcttccactataatgatgtcaaatgactttcaaatatatctcacattttagctcaacaaattccaagctatccttcccagtttcatcagcactctcagcactctcatcaagcagaaatgcaaatctttcttcctgcttcccctgctatcttcacaccttagtcccttcactatctgcctgttgagtttttctttgacattcaacacacgaggctcctccaccacctatgtatcacacatggtgacccaattctcctgaaccacactctatcacctgtcactcacttattcattggctccaacaatagccatttgtgccacatttaccatgtgcttgttaccaggctgccactaaggacaaaggcgaacaaagcatggaccctgtcctcgaggagctcacagggagaaacagacatgtcaatgaacaagtgcaatctgttataataagcataactagaaaagtggaaaaatagatggacataacacaggcgtaagaaagcgaggggtcaatttgcctgacaagaaaagacaatggatagaattttgcgtggaatctccaaagctaagcagggtactccaggaaagcaggtggggagtaggcaggacagcagggccacaggagcactcccatcaagaccctcccagtcctatacagacctaggaactcagtaccaggtttaataaggagccccgctgagagcaccagggaggcaggcagctaccgaaagggggttggggcttgcaggggactgctcagggtacattttctggttgcctcttttactctgagtgtaggcccccatctgcaccatgcccttcctgcccagatcctctttcccctccacccctcacatcaggagtagctttgtcaagagctccttcactgctcagccctctcacgggagctgccatggccgctgcctgactctgaaacacccctgaagccctccttttctcctcttactctagttctactagaaagccttaacagtcacaaagagtgcatctccaaaaaaaattattcaaccttgcctacgttttctctgtcaagtcacttccccaaagccccaaagacttgaagtgatctgctaattcccaagctcctacgaaataaggaaaggcttctgctatcccggacccaacacagcctgctgaactattttaaaaattaatcaatccgtaatgcatgtatgaagagccttctgcctaaagcacgcagattgcagggggagcatttcacagggtggacccaaagctgtgtgcaacggtgaggaaagggcatgctgtcattcccccaaaagtcccagatttcacaagcttacagtctgattaggagaatagacatgaatcagatttccagaaataaacagcaaattacaactaggataaatgctccaaaggaaacatccatggtgctaacagtggacagggaggggatgactcacagaggaggcaagggtgaccacatgagggtgggtgggggaggagtgagcagtgagaggagcccaagcaaggataatgccaagatagcagaagacagatggcatcttccaggaagggaaattaggtgaatgtgatcaaaatgaggcatattcagagaaacatttcagaggggatgaggatggaggactacttaagagttatgcagaagcctgaaggccaacttgagcatttaagatttgagtttgcactcccagtaatggctaagtatctgctatgagagcaaccattctcagactatttcttaaaaacacccttaaactatacagacctataaactcagtattagatttaataagcagcaccagggaggcaggcagctactgaaagggggtcggagcttgcaggggaatgctcagggtacatttctggttgtcttcctttactctgagtgcccccatctgcaccatgctggagcagatgaaaatgtgcagtcttactgtactgatgatggagggacaggtacggcagccctagtaactgaaaggaaagcaggatgtctggtagggagaaggagagtcccaaattctgtggatggatcctgctcatgtatctggctgacgtaggaccacacatgcacagggtagactccaggcagcccagctatggctaaaaataccttttgggctgctgtgatccactgggaaaatactgtttccattttgagttaagctgttgagtttacagttgaattaaagcattacagcgggggttttttgctcactgttttttattggtggcggggggtaaccagatttgcatgtttgcattttcagatagtgcttctgactttattgtgtggagcagattgtgctggggcaacagtgatgtaaccagacatcaggaggctgccaaaggcccctcatgtgagaggtcatggagcctcacaggactgggtcagaaggggcagagtctgaaagaagtggataccaagtcatcagagctggggtggggatccaacccaggctgacgaagcaagagagccaacaaggactccgtggtctcagacctgaaaccagaatagccatgacatttgtgatgatatgcaagctgggagaaagaccaggcttggtggggagcgtgagtggctttctggcagcagagtgtaaggtatattgagataccaagtaaaatgtcgggtgggctgattcacacggaagttagagagcggtcggggctaaagatataaatctacaagacaactgggtttaaggagtaatgaagctgtgggtgtgagtgggatcccctaaggataaaatatagggtaaaaagaaaaagggactcgggatccagccttcagaagaaatcccacagttttcatgaacaagttgagttggagacacctgcagagaagctagaaaaggcaaggtaaaaagaaaccagaacctttgtgttctctcaaaaaggccgcctacgtgatggttaagagcataaaacttctgacattctataagcctcaattcaaatacttcgtcaatatgtccacccatgacctcacactttcctgctctaacacttaaccctgatattccccctagaacctactactcctgcctagcccttcctcctccgcctcacatctcagggtcttgcagcttctgtaggtcccctatctgttctcactttgtaatcattattatcttttctcctccccagctttccaaccccattatatatatcattgtagggctcatgttgccatcctaaagtaacaaagactattacacagtatccttaaaaacataattttacagtctgatttgttctcttaaaagggacataaaagagtatttgaaatcagcaagactgaagctctacaaagactgatattttaaacatgtaagtgtccatgtaaactaatcatttttagtgggcctcactttacattatttgtttccttttgtcaattcgatatttaaatgactgactagtgaaatttcttgaccctgtttttaagggccactgtgacctacttataaccacgtgtcaactttaacaccggattccaaaaacaaggcacaatgtgagatgaaatgataatcaaagtggattactggaggtttgcttggaatcctggtcttccatgtggacatcgttttttggggacagcatctggggcttccttctgctaccacaaccatcctcaaagtatagtctggagacctcggtaggtgcccatggcctttttaagggtccacaaattcaaacctaataacatgaagtcattatgtggcttttaaaatctcattctctctctagtctacctcagagttttgatacagtatcaaagaagactattcataattatctaaaaagaaagccaacattaaaatgcatgccccttttccagccacacatctggaaaacagcaaatcacaacagactgaatacagaagcagatgtaagcaggcatccatcttctattaagcaggacgttaaagagctatgcaaaaatgtaaaacaatgccaatctctcatttcatgttctttcattttgggaaaaaaaaattttcataaaaagatattgttcatttagcatgtaatagatgtactatttttgtctttagtgaattattaaatactttttaaatttaattcctaacatggtaagtatctgccaacataactcacataagcaaagctctttggggccaggagacacatgagtactttggatcccatgcacagagtatgggttccaaaggtggctgggggagggctcagcattggccctccctctgctaagcctgcttgcccacaaagtgtacctacttctaggtggctgctatgaccccagaatccaaaaagtaaattgagcaaaagcccccagcccacagtgtttcctctgcccatataacatgcctctcattctctgcagatggaagcccagagaacagatattagaccaggactcgtattacacccagtacccatcagggcagttggacagtggctagaatattaaagaacttctgtaccccaagccaccaaagcacttcatgaccactccagctcctgcccaacaactcacaatcatacttgaccccttctgcaaataaaagggatagagcttggcaggctgaccccagtgcatcctacctaaccacctctagcttccccaggaccccatgggctggcccaagccctcccctccctcatagcccaccttaggttctgctctttttcttatatatttaaagtttcacccttccccatcagaacccatatgggccccaacacacacaccccaaccctctccctttattcctctccccacaatccctttgacccaggaggggcagatttagggggttttatttctttactttttatcctcttcctaatgtagagcagccagcctcttgcctagatatcaaagcagaagggccatccttgtaggctgcagaagacattctgatctgagtacgctgggctcagtctttgaaatgccacatgaatttcagatctactcttcttcccatgccatagcctaacaactttattactagtttctcaagctttgtagaactcttgcccccaaaagttcctgggggttatcatgtttttcttcccattccttcctttccaattacatcattttaaggccagtgattattagactttgcctcaccttagaatttcccagggaacttcaggtgtctagttgagctggtgtccaggttgagccctgaaccaactacataacaacctcaggatgggacccagggttcaagagtgtttcatgctctctggagatgccgctatgctgccaagactgagaaccagttatctaggctggatatttaggcatgtcttcttgattccctgcacttgacccccctccactgacccatatttagaactgtctgcggaaaagcgcctcttatgcccattctttccattggaacttcccctccctgaatgaatgggctgatagaagaagcaggctatgagtcaagtacaagagtattacactcaaaacaaacaaaaaaacaaaaaagcagcccttcttcaagagacacaagcccatttctattcccttatcttttcacagaccaagtatccctgcattcatttgcccttgtggtcactctcaggagagtgcagggcagatctgaccactgatcatgcaccagacaaagccacatgtcccacaaaagaacccctggaagctttataaactaccaatgactgcaccgctaccaaaaccaagtcactccagctttctgggatagggtcctggcagcaatatttttaaggttcccccaataattcttacatgcaaccagagagaagggctcagggaatctttgcaagtccagccttcttccttcttcccctacaaatatctgggtgatgtcttggttgccccagctttttttttttttttttggagacagagtctcagatgcccaggctggagtgcagtggtgtgatcttggctcagtgcaatctccacctcccgtggccgggctttctagtccatgttttcttttgtccattatcttgtatatcacctgggccacctgtgcttctgtccatgagtctttcagtctgttctgcctcattccaaagcccagcccagactcctatctccgacttcttcgctcagatggttgttggtcttaaatgagaagtacctagagcccaagggatgacagcactcattcaactgtgttttctaattgggctggtcaaacggtccacttcaaaattttttttaagttagtaaatgccttttttactgaaaaagtaatacatacttgtaataaaaaaaattccaacagcaaaagtgtattacaacaacgtaatctccttctacttcagttccctatcccccctctcccctcagagagaaggacttctatgcaaatacctgttcacttttgtacatctatcctgaggggctggtctactttgcagaaacaacatagattcttgtgatctgtctactgaataagactctgtgggaggaaaaaggaggaaggtcccatgaatctacctttaaagactgctcaggtggtcaaagattggatgggtgtgagaactgctgccaaaacacagtacctaacatggcctttaggcttttagggaacttggaaatatgataaaaagtgaatatatgttgaccctacgaaagttcatctgttaaagtcctaacccccagtacctcagaatgtaactgtgtttggacatgaggtctttaaagaggtaattaagttaaaatgaggtctttcccatgggccccaatccaatctgatttgtgtccttttaagaggaggaaattggccagacgtggtggctcacgcctgtaatccctgtactttgggaagccgaggcgggtggatcacttgaggtcagtagtttgagaccagcctggccaacatgacgaaaccccgtctctactaaaaatacaaaaaattagccagccgtggtggtgtgtgcctgtaatcccagctactcgggaggctgaggcaggagaatcgcttgaacctgggaagtggaggttgcagtgagccaagatcacgccattgtactccagccgtgagactctgtctcaaaaacaaaaacaaaaaaaaacagaagaggaaatttggacacacaaacagaggcagcagggagacacacacacacacacagaggaaataccgtgggaggacatggcgagaggccagccatctgcaaaccctggaggaaggcctcagaaaaaaccaaacctgcagacaccttgatcttggacttccagcttccagaactacatgaaaataaattgctgttatttaagccatccagtctgtagtaatttgttatgacagcgctagcaaactaatacagtaagttagttctatcctggtcacctagagatgctaaggaaggctataaacagatttatagacattggagactcctaaaatgaggtcatcagccccaaggccatggggcccctttgcaggtgaaaccacttcacagcaggtttctttgtgtggttcagttggtaaatttttggccaagatacaaagcaaaggttgccttataccaacttctacccagcatagtgagaatgaggttttcaggctttctggatgaggtttagcatttctctaaaatttaaaacatgaatgccagaaagtggtacacatacacatctaacataactggagaagaccatgtggtggtagggaggcttcctgatgaacaagtatagctgcaactgacaaagaactgtctgagtagcccagtgcagcaagttcagctcactctctaccttataccaaaggcctcggctttctcatgcctaagcacatgtcactgcgtgtgtgtgaaggggggtgatgggggagaaggaagggattaaggcagtatggcttctgcagaagagctgggactgcaaaaccagtgccttctgatggaaagccaacacatgaggaggagacacctggtttcttcctgctttgaaagtggacctggctttgatcaataagctattacaaatatgatgcacagttgtgagagaaaataacttctgtttcagaggaaatggcacagatgaagggaccgccattgcctttgaaagtcaataccaccccctgtagtgatgtagcagccacagccatatgcaatcactgtggctgagccgggcagcaggcagtctgctgattactggaatagcgctgcctcaaaaagcctgcagaggcgaggcttccttttgaatcagtgcaatggtcaacagagaggtctttcttttttcttttcttatccttttctgcctaaactctagaagcggacaataaccatcagagatctgttctgttacaaatccaatatatgcagtctgcccttctgggcactctatcaacagatctgccccagcccaccaatcttaaatcacactgtctacaatgctctcaaaaatattttatcacagacagtgcaatattctgtgtgtgcctttccactgaaattataattctagaggcatcagttgccctaataagaaacagagagtccagctgtaatctgatggagttacagtcaagaagccattgctttgtaaagctgatatgaacgcatctgaatttcaacctccaacctgtactgtgattattagcacatccagggttagggatgggtctttactggtgaaaatagtggcctctaaaatttctatgatgaatgttataactagcttcttagtgtgaaattaaagctatccaagatatgggtattggtgaaaatattttagagttaccccaacccttatacaaggtatatggatcctgagagacctgttagcttccccgcctccccaggcaacttgggtctagccaccaaggtgagaggtttctgcctatcagagggtgaccacaaaacacagagaactgggacttcacgaatcttacagaactggttggattatctctcgtgtcttttgctaatagtatttgtttagtaaatgtccatatgggtagcagaatttggtttgggactggctttctttaaactggcatttgaggttacaggagaatggctaaacctcagccacctttcattttttggaggctacattttataccaaaaagaacctaattggtttaggtcagtttagaaaacgtatccatcattattctccagacgggctgaagctctgcgagccttgtctctgttacttgtcctcccttctctaaccgccgacccaaaccgccgacccaaattctagacctccctcagggttcagccacttgaagatcatttccacttgaagaacactttctatggaaagtattcctcacctaatggctttactttgtgccccaaaaacaagggctaaagaaatcacgctagactttatccactttgccatgcctgtttggcaatgttgtttaggtcttaacacttcatgcctatattctaagtccttgcaaggcaaggacctcatttgccacactagttaattattttgtatctccccaagcaataaatccaatcccatgaacacagcaggacttgctaaatgcacccactgcttctgcatctactgtgtgcatgacaactttggggctaagaagggagacaacaatttggctccgatccccaagaagtcatccaggagaagagaatgaatgtcgatggttcagagaggcaagtctcttagcctctgcactcaagcattttaccatgaaaacatctgtgttatgtaatttctagggcaccaggaaaaatggctacttacccagaagactaaggatgatcttaacttttcctccagctaattatttaaagggatgtaacatgaggttttcttaaaacaaaacaaaacaaaataacagctagatatggctgggcacggtggctcatgcctataatcccagcactttgggaggccaaggtgggtagatcacaaggtcaggagttccagaccagcctggccaatatggtgaaaccccgtctctactaaaaatacaaaaattagctgggcgtggtggcgcatgcctgtaatcccagctactcgggagtctgaggcaggagaatcacttgaacccaggaggcagaggttgcagtgagccgagatcacgccgctgcactccagtctgggtgacagagcaagactccatctcaaaaaacaaaaaaacaaaaaacaaacaaaaacacctagatttgcaactggtgtgttcaagttaacaatccactactgtgtgtgtaagtttaggctaaccgcacgtctatacccagaacttaggcactggctgtttttgacttcaataactttcctgaaatgacaaagtaggcatgtattatatctttgcctaaagacaacttttatgagatcatacattcccattcttgggagggttctttcttttttctttttgctgaattaacatttgaaagaagaagtcatttggttttattaagcatgattcttctactttggtagactaagcagttcaaaatgtactaggaagatgatgaaagcaaccaaacaatttatctgaagagaaagataaaattactaagagcctgcagattaaagaacacattttctgttttagattgatatataaacacaacacttaaagaggaaacatgagccaaggacgcatcttcaatacagtccctcaaattttaactttaattaatcctccgaatttcataacaatgtattttctaatgacacggggactcacttcggaattctaagtaagactgttactgttcccaacgcatccttgtgttcctaatgactaagctttaaactattaatacatatcttaggttaattaagtgggctaattttccttgcctaataattgttcacgataatctaacactgtttaagctccaaaataaccatctttgaaaaatatacatccttaagtgtgtctcctcctattatcagtggggaaaatgtgacagtaaattactgagtaggaagtacagaattcccaaatacaaaggggcccagattttaaagtacttccaattttatggcacaataatctaatcttatcctcacaaagcctcctcatctcctggctccaagatcagaggaaattctttaagagagagggacgaggtagaagccgtgtgtacgtggttttgagaccttccctaagctaggcctattcctgctggcctctagttatgagaaagaacactgaggcctctcgcacatggctttgccaccaccagatggcacatcaccatgaaagcaggttacagacagaattctgccacagaaatcaatgtttcttggcaagcagtcatgaaacaatctgttcctagaaactctgcaaggtcccaggtcttggccacttagaaactcctcaagtcccttgcatgatcaggacacagaattcccaattaagaggcaggaagcaaaacaacagagagccctagatgaagggcaatactctaaaggagaacatgtagcagctgggccctccagattcctgcacccctgtccacagacaggcagaggggcctggacagggattaaccaacccacaatattccaacgatcatgcgcaccacccatttctttcaataaaacttatctgcaataatcctcatgctaattaacaattatctagtgcagacatttacagatggaggtcgttgaagacgggaagtggacatggaactgcgaattcttgttggctatctttaaaatgctaaccgtgcctaccattggaatgtgtatttctcttttggacactataaatgccaactaaccacccttaggacatagagtgaaactagcccacacatataaatattttacaccatctatactaaaatattttagaggaaaattatagacagacaacagtatgagcttaaggatggagtcggcactcaggatgtatgaccaccagaggagttcagagggacaggagtgactactgtcttcatttctccattccactctctcttatacagcccaagttttctgaaatagtataccaaggggaacttctttccctctcaatttgaacacaagacagcaaaatagctaaaggtggccgagtgtggtagctcatacctataatcccagcactttgggaagctgaggtgggcagatcacctgaggtcaggagttcaagaccagcctaaccaatatggtgaaaccccatctctactaaaaatacaaaaattagctgggtgtggtggcaggtgcctgtaatcccagctactcgggaggctgaggcagaagaattgcttgaacccgggaggtggaggttgcagtaagcccagatcgcgccactgcactccagcctgggcaacagagcaagactctgtctaaaaaaaaaaaaaaaatagctaaaggtgaaaatttcaaataagcagcctctcacaagaagacaaaaactagactctatgtaaatagatatgaaaacagtgccctctttaaagtgctttttttctccctgcttaatggtctagaaaagacacataattgccttataatcttacagaacctctatttgagcaacaaagttgagatgtcccaatggagtccagttggtgattacatcattagaaggtggttcccagcctgtggtccggtccccaaatgaatcaatcgatttggttgttcccagtttttttctattacaaataaagctgaatcatacaatatttggagtgaagataagtctccatttctctaagataaatgcccaaaagtgcattcgcttggtcatatggtaaggaaatgtttagtttcataagggcagtcatgcaagacagaagtaggcagaattcagagaggcagaattgtatactgggtacagatatgttctctctctgaaactaaatgtcttagttttatacacaagcttcacaacttaccacccatcagatcctcattgatcaaatggagattataatgataatgaggccatttcaacagcatcatggtgatgatttgattagttaattcatgacatgttcttagaaccacctctgacaaacactatcctttccacagatgttagctactaaaatttgcatgatttcagccaccagtaagatttaatattttaccctatattcattaacttactgaatttcttctcttatggattaaatgttcatgcttgaaaatacaagaaaagatttcattttgtttcagtatcaaatgcagcactgcattcaagaaagcttaaacacagaaacatcccgccagtggggcagagtacagtcgatttacacaagccagagttatatgtttcattatgtataggatatcactctatagtctaagatacacttgctcaaatggtttttttttttttttttttttagacggagtctggctctgtcgcccaggctggagtgcagtggcgtgatctcggctcactgcaagctccgcgtcccgggttcatgccattctcctgcctcagcctcccgagcagctgggactacaggcacctgccaccatgcccggctaatttttttttgtatttttagtagagacggggtttcaccgtgttaggcaggatggtctcgatctcctgacctcgtgatccgcccgcctcggcctcctgctcaaacggatttaatttgcgtggggaagaataatgctggttgcattcagccgcaacagagcagttgatcaggaacagaccctgtctgagaagcgtgtctctgtttgcactagtcgtcctcggaggacacaataccttggctcagattcgcagctgctttgctttgtacccttcactcactcagtaaataggtactagtgcctcccattagggccctgggttggaccctgagaagaccacagagaagggtaggcatctctccaggagctttgatcctgaacttgacttaaacaccagaacaaatggctgtgaaaggtggcaaacagctcaatacaaatgaatgtcacagtctagagatgatgtagcagcagaaaaaaggaattgctagagattgtaggggacaaagtaaagatgaaataagacttcttacagaaagcgactctggtgagactaagctaccagagaacctgtttgggctgagagaaaaccatcagcctagaaaagagggcatggccaaaagtttaggtatgcacaggggcgttcattcttctggaaaacaatgtggccagaggggacagtagaagccaggaaacaataagaaaaaaatattgaaagaattgtagtctgaatgtagaagctctagaatactgactgagtttacactttgctctgggtataataggggcctttgaaagctttgtaaaaggaagtgtacatcataagcagggtattttaggggataaatcttcctgcagtaagaagaatgaattggaaggggaaaagacagaaagtaaggcactctgtgggaaaataatttcaactgcgcaagcatgaagcgatgtggatccaggccggagacaggcaagaagactggaagtcagattgttctatttattttccggagaaaaagaaagcacacctatgctagaaaaatagcttcggcaaatgccccatataataaattgtccttcacttactccacccatgtgtttttgctttaactaaccatgaatagctgcttcagcaccagcctgtttatcatcctcccacgtccagcctagcaggactgaactgaaaggatctcagagtagtggactcgctggactgcaagatgctactcctgttaatcttccattactctttgatgttacgtctgtccctcagatatcacgggcaaagcatgccaagatattacagttgacacctggggtaagccagtcttttatcccctattatagctgtatagctcttaaacatagtgtgtcattgaataccatgctctactatttagccttactaaagacctgtgaggttataaaatctttattacaaatttcttattcataagtttataatttaacagtatgctattgaggcatacatgaactgagtgggtcaactaccacactgtggacatgttctagaatgttactgtgcttttggttcttcccagagggctgctgtctccccagatcctggaagcagaatccctgtagagcacataacacccccaaatttaacccagccatggctgtcatttggctggccagcaacccatgagataatttcttctaaaatttggctttcaatttctggtccagcatataaggagcttggaagtcaccactccaccttaacaacaagtcaaaagctaaacaaatggaaacatcaaaaattcttcttagatccatcatagaggtgaggtcacagggcaaacttctgccccacaaactggagagacaggcagatactaaaaatcacaacttactggagcagaaatccatgagcagaagcctctttggaaagtcacgctggggtaggaaaatctgaaccgtaattgacagttgctataaactcagcgtggacaggtctgaaagttaaaaactacagatcaatacagtgatcagtccccacctccccatacccctcaccacctttgaaaattttaatctcatggagcttaaccaggttctcacggtggctatcggagaaaaaatcactcgtgtcttcagcaggtagaagggaaaagtaaccattttgaaatatatcagataattcttttttaaaaaaaaatgtgtgagtatgtagtaagtgtatatatttctggtgtacatgagatgttttgatacaggcatgcaatgtgaaataagcacatcatgaataatgggtcatccgtcccctcaagcatttatcctttgagttacaaacaatccaagtacactcaggttattttaaaatgtacagttgagttactattgactatagccaccttgttctgctatcaaacagtaggtattattcatccatttttttgtacacattaaccatccccacctctataagtaagtgaaaaaacctacaagtaagtgagaacatgtgatgtttgtctttctgtgcctagcttatttcatttaacataataatctccagtttcatccatgttgtcctttattttttccaataggtttttggggaacaggtggtgcttggttacatggataagttttccgtggtgatttctgagattctggtgcagccatcacctaagcagtgtacactgtacccaatgtgtagtcttttatcccaaccctcacccaccctttcccccaagtccccaaagtccattgtatcatttttatacctttgtgttctcatagcttagctcctactgatgagtgagaacagatgatgtttggttttccatttccgagttacttcacttagaatactggtctagccacccaacagacctaccaggctctgggctggtactggagaatgtctgcaaggagtcctgtgatgtgatccatcttcaggtctctcagctgtggataccagcacctgctctggtggaggggagttaagtggactctgcaagggtcattggttatatttttgttaagtgtgctggttttgtgttgtttggcctccagccagactctccttgggtgaggcttgctgcagctgccatgacagatgggagtatggttcctaggccaacagagttgtgttcccaaggggattatggctgcctctgttgtgtcacacaagttgccagggaagtggaggaaagccaggaaccacaggcctcactcagttcctgtgcagcccagagctagagagaccagtctcactctcaccatgctccacaaacagcactgagtttacttccaggcagcaagtgagcaggcctgagaacctgccccaggctacaagcctcccagctgataaagcaagcagactcacagttcctcagctgtcccacagaacctgcaatggcaatccacctccttcaaagggtctgtggattcttttggcttttctggtacattcttgcagtagttcctggagcaaaagttcattatgtgggtctccacatcctgctctgtccatctgagtggtaactgcaagttagtcctgcctcctagccaccactttcccccagaaaatatccctgttgctctttttaacaagctctgactgcaagataaagtattttaccaaagcctgatcttctggggatgtatcagagcctaattgacctgatggaaggaaaatacccccaatcaagctagctctagccttacatataggagaaaggacacccaaatccagcccccgacatccatcctgtctcatctaaggcttgagacctacccataggactatgaaacactgtcctacatcttaccacccaccacacactaaaggcctatttacaagacttccttttgcccagtacatcacatccacatttcaccaaacatgacaaggcacactaaacggcaaaaaatacagtctgaagagacagagtaagcattgaaaacagacccagatatggcagggatgttgaaactattagaccatgaatttaaaaagactataattaacatgcttaaagccctaatagcaaaagtagatagcatgtaagaacagataaataatgtaagcagatatctagaaattccaagaaagaataaaaaagaacactagagaacaaaaacactgtaacagaaaggaaaaatgcctttgatggctcattagtagaccgaatacagctgaggagaaaaatcactgagcttgactacattaaaacagaaacttcaaaaactgaaaagcaaagagaaaaaagacagcaaaagaaacagaacataatatccaagaactgtggaacaactatgaaaggtgtacatgtaatggtaataacaaaaggagaagaaatagagaacacaaaagaaaaaagtatttgaaacaataatggcttagaatttcccccaaattaatgttagacatcaaaccacaaatcttgtaagctcagggaacaccagacaggaaaaataccaaaaaattcctgcacctaagcatgtcatatgtaaatggcagaaaatcaagacacagaaatatcttgaaagaagccagaggtgcaggaaaaaccttatgtatagagaagcaaatatgaaaagttacatccaatttctcttcagaagccatataggtaagaaaagggtaaaatgaaatatttaacatgttgggagaaaaagaaatgaacctagaactttgtactctgcgaaattattcttcaaaaaatgaaagagaaatcaacactttctcagacaaacaaacattgagggaatttgctaccagtagacatgcctcaaaagaaatgttaaaagttcttcagagagaaaaaactaaagatatgtcagaaactttcatctacattaagaaaggaagagtattaaaaaagaaataaaataaaagcatgtgaaatgtattcaggagcttatagaatttactgaacctggtcagttttccacaggatgagcagtgaattgtactgcatcttaacagtatgtattaggattcttgcagtggcatgcaggaagatatattttaccagatattattcttccaagatactgagccccaggggggaggaaacttgtggaagctggccaaacagattaagagaaaaaaactgctgtagtctccatatcatgaggaattgctgtagcctgctacatggtagtcctatgatcctaaattggcccagattcttgtctagattcaggcgttaggtcaagagctctccaaagtgctgcacttactgttccaccctctgctgaaagaccaggaatatagcacaggttgacagccaaaacagggatttaaagaatgtgagaaggcctggaagaaactaatgaagaacaatggggaggagttggagttccaaggtaccaaaccacagatttatcccccagacaggagagacttgtggaccccatcttggctgtttcttctttcttcgttttgtatttcagaaatgtatcctttagttttgatgatttggttcagactgagattgcaatgtgatttctgttctccaacataattctgtttctttatctcagttggagaatcaaatagcatattaatatgatacattacactagatttcacctagagtgggtaataaaatctattttccaaccttttcagtctgagctcaaataaagttaatctaatttaatatgtcatcaataaaagttggtctatgggccaacagttatttagggaagggggatggggagaagtttgaaggataatttagaggttggtttgatttaagacaagttcaagtttagcaatgcaattttgctgcatttactatacatctctatgatgaatgcaaggcagaaaaaccaacctttacaatttctatctataattaatgagtggcttctagcagggttggggtgaggagagaagaattgtgattataggagaccagctcaattgagtgatgtcaaatcttctagaggccaatgtaaaccactcagcattcccacttgtatattctggggttttgcattttttttaactcatgatagaatgaaacctgattagaaaggaggcaaagagactaatgataagatgatggtttaaattattgaagccaattaattacacacaataagtgccactaatagtggtagtgtgggattgctaagaaagtgtttacgggattgggagggagactcagccctaacatctccttctctgtctctccagagcaggatctctcccagaggtctctgctcacagacaaactccaccccagtggggcagtcatagtaagaaattccaagtataggagctttagtcctactaaagtattcagaattccatcctgcttcccactaggtgaagcctaagcactgaaggctgactctcagccctcttctctccttccttgctgcttcctggagagtggcctccaggagaatggacagggatttgcaatcccatccagggtgggaagcaggaagtgagaagcggtagtaaccatactgcatgtctcccattcctacaacacctcccttcctgaatccagctcagctagctggagatcatacttagtctcctggcaaagtgagcctgcttctataccccatcctctgacaggggcattgtttggaatgggcagactgcctggaactgcaaccctaccggacttggagcatcacctactttgctaattgccctacactgcctgtgagaatgaacaccgtttctccattgacccacatcctagggcaaaggtatgtcttccccattcctgatctttccctcaagtggacatcacacaatctgcttgacccagtattctaataaaagaatctaaacaaaacacagttattttgttagggatatactgttttcaacaccttggtcagtggttgtcaaccctgattatatgcacctaaaaatttaaaaagaaaaaaaaagccaacatcaggccctgtctcatgggaattatgaactaagtagtctgggtggagccaatgcgttggcatttttgctctgaagtgcagccaggggtaagaacaagtgagttaactagttagactccaaaccctctgatccccacatagctcccatgttgggagggccaccttccatgccccttcagtctgtgcctgctgggtctcttgcttctaaatgatgagtttatgtgccaatggtgcatgcacctgctccccaaagtgaggcaatgtgattgtgggaaggacaaaacacaaggaatgaagaaatgacaatgctccctattgaaatacctgatgagactactgaagcaatcagaatgagcaatttgaacacttcaggtcttgccttgtgccagaaaaactgcagtagaaaattcatagagcttgaaagaggtctcgtgaggtctttttgttcgtggccattttgcacagatgaagaggaacctaactttgccaacttccaaaggaagactccagaagaaatttcatctagtgactccggagtgtagctctgatgctacctagaaaatcttctactgaagtccctctgcagaggctgctgtgctagtttcctggggggcaagaaagagaggagctccaaagcccaatcacttcatagtaaatgacagcatacttttagtcagaagaaatcacattttgcttccatttctttatattaataaaatattgccatgttaaaaaaaacttcatcccgctacaatgaagcttttcaagatttttttcttagaaaatggcataagccaatataataccttataggtaacacctggaaacaattgaaaaagcaaagaaatgatagttgaacacaaaaattccagacccctaatgtattgatcccctattttccactagcgacattcatttcaccaagatttgccacaggatgagagaagaaaatgacaaagacacaggaaacgtaccatcaataaccaatatgctgtgtattttctgagagtcagtcatgtaactatctaatgaccaacaaattgtgcaccagtttcttgttcaaacagtgtaaatatgtgtgtatatacatatatatgtgtgtgtgtatatatatatatatatatgcatactatggtggaaataaaagtcataaatctttaaaaatgaatctattcttgctcaaaatttaaaaaaaaagaaaattcccgtgttggttttctggttttgatattacatgggagtcatatggaacgttaccataatacgaaattgagtgaaggctacaccaggtctccctgtacattttttttttggcaacttcctgtgggtttctaattattccaaaataaaaaaagtttaaaagacaaaatgtaagaaaagaaactctacccataaaagaaataaagtggggccttagaaggaaagaagactatgcaagaactgtacagaccatcagtagtaataatagaaatagtagttgcaattgtagcagcatcagtagcaacagtagcaggagtagtagtaacagacagtagtagtagcaatagtagcagtagtagtgggcagtaatagcagtagtagtaacaatagcggtagtaatagcagcagtagtaacagtagcaatagtactagttatagcagtagcataacagtagcggtagtagtaataatagcagtactgtaacagtagcagtggtggtactaatggacagtagcagtagttgatagaaaatatttatattctcaagccactggggcagagtgaagaaggagctatgctacgttggaagggaaatgaatatcttacttaaatttaaatctatgtaggatttatctctcattatatttactaaaaggaagcaagaagctttccaaaataattcagtcctaagctatacatttcttacctactttccctagcacgcaatcttcgatttgacagcatgtgaaaatctcaaagcatgtgaaaccgtacattattcattaaatctatagaatatgtttgttatcagatatgggatttacttaatttacaaatgagttccactacctggtattaactgccccacactatattaggcatgtgagatcttctattcagaaagctctagcctctctgggccttagctttctccttacaggccggcttgagaataactactctagcagactatacccaaacacaatttaaatttgcttccttttgaagcatctcccaccatcagtcacacagagagaggcaatggagctggaaatggaagcacccccaaggttctggagatgcttagaacacaaagtacctgccacatgtgccggatgctgctctagacatgaagggctcagcgaagggctcagcaaagggcacaatagccactgtctttctgtcctcaagaaggaaaatcagcactgaacaagacgatctcaggtagggttcaaaactacagagaaaataaacaaggaacgtgatagagaatggtggcttgcagaggccctgggtcagagatctctctgcaagaaaacatttgagcagagacccaagaaaccaccaggagcaagccacagggaagaatttcccagaacagggacatcaaaggccctgacgtgaaaatcagtctgagctttgtgataaacagaagtaggaaggactagagtagacagaggcagagaggaagggaggggccaggtcatcaagtctctgtgatgggtcagacatgggggtgtaaggaggaggcttcagtgagaaaagtttccagatttctgttttgaggcactagctggaagagataccacttactgggcttgaagaagagaagcctaggtccagtttagaacatgtcaagtatggaatgctgctaagacacccttcctgccccggatctctggcctgtgggccaggataacccagagtcccccttgcagggatcccccactgcagccactcccctctagagcctgggaagctgatgtggatgcctaaggtctcaggacccacgaacccctcatcagcctctgccttgcccttgtcccctgagcctgggcgaaccactaatccccatatgtgagtctcctgttcctctgtggtgtctgtatcaattcctatggcttctgccacaaactgccacaaacatagtggcttaaaccaacacaaatctgttataattctggagatcagaaatcccaaatgcaccaccctgagctaagatccagtgttccttctggagactctggagggaatcggttccttgccttttccagcttctagaggctgcccacgttctttgggccatggccccttgctccatcttcaaagcccagtcacacccctccaacctctgcttctttcatcctatttcctctgactctcttcctccctcatgtaagaatgcctgtgattaccatgttcccacgctgataatccagggtcatctccccatccagattgtcaatcccatctgcaaagtccctttttcccacatagggcaacatatccatagattcgaaagactaagacatgggcatctttgaaggggctattattctgtcaatgataataccctaaatcctcttcctcacactgcaggttatttctcattctctatcctgccacagggtttttactggaaaaaatcagacagaaccagttctggcaggaatggaaggtacgaaaagaagaaatacagaaagaaatcacacactgaaattaacaaccgaaaatactacacaaccacaaaattgtaaaaaaatgtatatttacaatccaatccaaagttttacaaacgtgttaaaaactttagaccagttaaattcaattgagtttaattgagtaaagaacaattcatgaatcagtcagctctggaaccagaatatgttcagagaggctgcagtgtggctgcatggtcaaagactgatggacagaaaacagaagtgggtacacaaactgccaactgtttacagcttggtgtttgccttatttgaacatggtttcaatagttggctgccttttgccaaaacttggtgactggccagaactaaatgattggcacaagagtaggttatggtctgtttccacatccagttaggttacagtctactatgtacagagagacctttaggctgaacctaaaatacgtaaggaaccagctttagactagacttaatttaacacatgtattagggtataggaccagtgtacacaattcaagattaagacatacataagattgctgatgtcaagttcataatcaatttatgcacagttaaatagattcagtgccttttgggattgaagagggaagagagacacacactgggtgttggcttccattcaatgaaacaccagaagctgggtaccaaagcagcaccactgtatactgtgcctccctgggatctgggcagggtccctgcacagaaagcacatctctgtggcagggatggaagtcattacttaggaataaaagtagcccaaggacctgcctggcctcccccagcccagcagaactgagatgtggtagcaggcacactctcctgggaactctcagataggtcatgactgttgtcccccacctgggagagccatgggtctctcctcctccaccttgtgagctcttggaccccatgggtaggaagcagctcctctgggaaaatggtagatggatattgcatcaaatacacggccagcagccaatgccatgtggcatgccgcccacctcggctccaaccctctctccccaaccaccacttctgctcttccatattcttcccaaccctcctgctcatagcaccctcacttttcacctccctccagcacaaaagattttgaaatgggaacttgccttctgctagggttatgatgaataacattttcaatcacaacacatttcaatcataaggaaaatagctttagaggatccccagggagtaggagtaggtgaagaaaaagcatattcatacaagttagattacctattttttttaaaacagaaagttgccaatgagaaaatgggactccttttgagccactaaaatgttaatgtctgcgcatacctaaagagctatggattcctaatctttcttcctcaaaacagtaacatgctttggggtttagagagcagattctaagtctgaagcccacacccatggggacagcaccacagcttaaccctaagtggtcctattggcagaaactaaattggaagattctggatgtctgcagcctagtaggatggcagggttcagtcactggaaaaccgtcacatatgtgtctttgagccttccccacaaggtgtgcagaactcttctagaaggacatagagctgaggttttatcaggctcaaggttatcttgcctgctttctgtagatagcaaattttgttcaagacttgctttcactacagactagtagcaaggtgtattagtcagggttctctagaggaacagaataggagatagagagaaagagagagagagagagagaagtttattaagtaatattaactcacaccatcacaaggtcccacaataggccatctacaagctgaggagcaaggaagccactccaggtcccaaggctgaagaacctggagtcctatgttggagggcaggaagcatccagcacaggacgaagatgtaggctgggaggctaagccagtctaagcttttcacgtttttctgcctgctttatattcactggcagttaattgatgcccacccagattcagggtgggtctgccttccccagcccactgactcaaatgttaatctcctttggcaacaccctcacaggcacacccagaatcaaaacttggcatccttcaatccaatcaagttgacgctcagtattaatcatcacacaaggtttgagggcataactaaccatcaaccacctcttactgttgaccagacaattaccaagcaaggaacacatcagagctgggtatcgggcaccaagttcagggcagtcctcagtggtgatatttagtgagtgtctactgtgtgccaggccaggggttactgaaatggatgacaggactgtctttctctttcaaggggctccctctcctgtagctcagtggttatgtggccttgccaggctgaccagaacaaacaccaatgctaccatttcctagaaagccagtgtgagcactgtctggacagcacacactattgaaggcccaggtgagggcccaaagaaggcattgcccacaggtggtgcccagacagacaatccctgatctcctggccctgggtgatcacacctggatgaaaggtctgggtgatcacacctggatgaaaggtctgggtgatcacacctggatgaaaggtctggggaatcacacctggatgaaagctctggggaatcacacctgggtgaaagctctagggaaagaccttttattttttgtttttgttttttgtttttgagatagagtcttgctccatcgcccaggctggaaggcagtggcatgatctcagctcactgcaacctccgcttcccaggttcaagcgattctcctgcctcagcctcccaagtatctgggactgcaggcacgtaccaccattcctggttaattttttgtatttttagtagagtcagggtttcaccgtgtcagccaggatggtctcgctctcctgacctcgtgatccgcccacctcagcctcccaaagtgctgagattacaggcataagccactgcacccggccaggaaagaccatttttacaggcagtgcacacccaccagtgctcaaaggccttgggtcctcaacgatgcattattataaacctccacggctcacaagtttttaatactgcacaagcttactagaggagattgccacaagttcacaagaggagaatagatatgtgtgtacagaggctaaatgggagcttacaagatgagaattcacacaagcttataggaaaatatacacacaggctcacatggagagatgcacgtggggccacataaagagatgcacacaggctcgcatggagagatgcacacaggctcacagggagagatgcatgaggctcacatggagagattacacaggctcacatggggagatgcatgaggctcacatggagagattacacgggctcacatggggagatgcatgaggctcacatggagagattacacaggctcacatggggagatgcatgaggctcacatggggagatgcatgaggctcacatggagagattaaacaggctcacatggggagatgcatgaggctcacatgaggagatgcatgaggctcacatggagagattacacaggctcacatggggagatgcatgaggctcacatgaggagatgcatgaggctcacatgaggagatgcatgaggctcacatggagagattacacaggctcacatgaggagatgcatgaggctcacatgaggagatgcatgaggctcacatggagagattacacaggctcacatgaggagatgcatgaggctcacatgaggagatgcatgaggctcacatggagagattacacaggctcacatggagagatgcatgaggtttacatggagattgtacattgacttacatggagacaggcacatgtgctcacacggagagatgctcacaactgttggagccctcagaggccatcttatccaattcagtttacagaaggaaaatggagccaggaagattaatgtcttactccagacaacctggccatttcaggacagtcccagaattggagattatggtcatctgacaagatgtgttgttttttaatctccattcatactaaaaaattactaaggcacaatttcacccagggatgcttccggctttgtgtacaagcaggacaaggagaactggactgaaatctgcggctctggggcagttccctcagggctgcctgttggctgacaaaggagcatcagatagtccttttataagataactctcttcagcagtctcacactggcccactccaggccaaggtactcctccctaagtatctactgcccggcttctctcaggatatcccggtcctgctcacatctccctggtgagaatgcctgtcctcacccccaaccacagtagggtccctctcaccctcagcccccatgcctcctttagttttccttttagtgtttatgctacatggtattttacgtttttgttttgttttgttttgttttgtttttttaggtagagtctcactctatcacccaggctggagtgtagtggtacaatttcagctcactgcaacatccgccccccaggttcaagtgattctcctgcctcagcctctccagtagctgagatagaggcacacaccaccatacgtggctaatttttaaaatatttttggtagagatggggtttcaccatgttggccagctggtctcgaactcctgacctcaagagctcagcccaccttggcctcccaaagtgctggggttggtattttactttttgtgctttatcttctttactatctagagtgttctctgggagagggtagaaagagaggcagtttgcttgctgctttactcttagtgcctagaacagaggatggcatgtaatagacactcaatcagcacagcatgaataaaataatgagttaaacacatttcatttctaaatgcaaatattgctctgttttgtttgcaaaaggctatcttgaaggacatatgttgttacatttaaaaaaaattctggcaagtttccagaaaacaatgatctcttatctttatagctcactatggttcctcgaaccgtaatcatagaataaatgaatgactactgaatgggtaaggaagaagaaacatgcattagtttctctgtgatctcgccaccagcgaattaggctttcaaatgtccatctgcctggctgggctcagtggctcatgcctgtaatcccaacacaggcgattactatgagatcaagatgggaggatcacttgagatcaggagttcaaaaccagcctggccaatatggtgaaaccccgtttctactaaaaatacaaataaagaaataaataaaattagccgagcatggtgggtggtgtgtgcctgtaatcctagctactccggaggctgaggcaggagaatcacttgagcctgggaagcagaggttgcagtgagctgagatggcgctactctactctaaccagtgcaacagagtgagactctgtctcaaaaaaaaaaaaaagtccatcttctctattgtgagataaggagggggaaaggggacatactctgcaaatgcctccacctgaggacgagctccagatgacaactgtgtggtgtcactgtgccatcggaaattttcatacagctctctagactccttccgagggcatatttgtaaattattcagaagtgatggaaaataacattacacatagtctttcattttcctgacaaactgtcttaaagcaaatgcaaatggtcatgatgctcttcgagatcactccatgcttggatgaataacctgggatatataaataatgtaggtaattccaaggagcctttaccttaagtaacagttacgctccgtagcaggtcctcagtaaatgttcactggactagaagcttcctcccagtggtgcccacatagacaataaattccctgagagggaagtcaccaccgcttcaccccgccccacccctcttccagagttatcatggtacagccaagagggacccctgacaagtacctcgtacaggtcgccactgactgaacggtttgaaatcagttatctgggcaggcaaggtgaaatatgtttaatgcaaaccattttggcaaattggccagtatgaccaccagaaactgatagctgtgagcagccagtaagcagtactatgtgatcatttgcatgagtttaaaattatgttgaaagagaaacaagaaagctagtccaaatatccaacatttataaaagcagaatctcaattatattatcattaaacctagatgtttggtttgtatctgagcttgctgtgtccttttgaacctcctttccccactgccctgcacgcctcgtgtgtgcacgtgcacacacacacacacagtccacactctaaaatgcctccactgacaacaacctctctaataatgcagcgtggagaagagagctagaaaactgttatcatgttattcctccagaactcaagtgacaggagaaaatattttccagccctcacatccttgagatgctaaaacctgatctgcagttactttggtgctgaatacgagtgcctgatggatacggcactgtagcaagaccgatgatgccactgtgcgaaaccataaattgtgcacttatttaagatgatttgaatgcagaacaaaaggtaccttggaaataaccatccagcaaacgaaactgcattcctgagtggctaggcctgaatttaatgaaatgatgtgaaacatgtgcctgtagtatctaaaagatttgaaatataggtccttgttctgttaggaatagtttgggtttgcattgctaattaagttcccagtgaagggtgtgtgtgtgtgtgtgtgtgtttgtgtgtgtgtacatgcgaacacaagtgcctgtacatctacttgtgtgtataagccaatagcaaatagctacacaaaacacgcaatgctagaaacagcattactatacaagagaacacccttaagtttcagcatccagcctgcaggatttgaatgcaagcactgaattaagaggttgctttagggatcaggatggtcatgactccctagtaatcacttccctttgccactaccagcctctgcatgcaaagatatctaacgcaggtccacagagaataatctgaaagctaggaggccacagggaccttcgggatgcaaacattaagacataaaaacaaactcagccaatgcgaaaagaaaaattaaattacctttaaaagtgttacgaagccagctaggaacactaaggaaatttatacgagcctttgctaactgtctttgctgctagaatcttaattccagaaggcactgatgtgcagtcccttcagattctcgaacacacacagggatgagggttccacacagggtcaacatgcagttcccacgtgaggtgggccaaaacttcagggaagacaaccgttaacaaaataagagaaatgacagcttaaatgtgaatttggagaacaccttttaaattgtttgcacagatgtgacattatttacatgacaattccatgctcctcagcacagagaaaataaaacgagttagacgacgttaaagcaaccattaattctattaatgagttaaggattgtttctagaacttttccgttgcttcatcatcttgatataattaaaaatatttgttatatctgcaatgttgtttcagcacctactgggaaaagcaagtcagaaagaaaaaaagtttgctagttttcctggaaaaagaatgtttactcttgtcaaaaatgttgaaggcctttgggttcatttatttaggctgatcccattagtcaaaatgttgaaaaatgttttaggactaaatatttttccactccatgaagagcgttgactacaatacttatttcagaaagcaacaaagaaataggcatgtatcaaccaaaaaaaaatcacttagcttctttaacttgatgttgctaccgtttcctcaaactcagctgaatcagctccgtttaagtggcaatgctttggaagcaaaaaatgataggtgacagtgtggcaagctccatttcgaaaacacaggaggaattctcttcccttctcactcacatttcatcacttacttgcaatttctgtaaagtactctccaaactgggaaagatgaggaggccgtgggaaagattctcattcaagaaattcgagactcaccctttaccctgtaaaatattccgtgttgttgatctgtaaatagaattatagctccaccaccaccaagccgtgatgcaaaagtgcctgggtgaactaaaattaaatgccaatgaaaaatgcctctctgcacatcagcatctatctgcttgggccttttttggcttcctcatttgtctttattttcatttagagccacgtggtgtactgcctttcgctcaaggcactctccctcacagtcgtgggtgactgcgtgttgtccttgccacccacagagctacatgggggaaagaaattacttattgattttcctttctatggaatggtgtctttggctggtttcttgagacagggcagtaatgcacagagccccagcagtggggatgcaggcagtgtgccacactgggctacaccaccagggtcaccctctctcaccagggtcacctgcacttagctctttcaacaaaataaacagcatacacttcaaaagttgaaagaatgaacaaaacaatggtatgttcccatctgagtagtggaaacagcatgatttgaattttcttttactcttgtattctaaaaaaggtttggttgggatggcatactatctggttggttaaggaagtatatttgacattttcaggttggtcctaaatttaaagtcagaaaaaaaaattaggaatgctgtgagttgtgaatcaagtcttcataattttgggccgattaccagagatgccatttttggattcctgaattgttactagagatagtggtctgggctgagagcagtggttcatgcctgtaatcctagcattttgggaggctgaggtaggaggatcgcttgaggccaagagttcaagaccagctggagcaacatagagagagaccccatctctagaaaaaacatttaaaaattagctgggtgtgttggtgcatacctatagtctcagaaggctggtgtaggaggattgccaggagttctaggctgcagtgagctctgattgcaccactgctctctctagcctggacagcagagtgagaccccatctctaaaaaaaaataataataatagtaaaggacagagatagtggtctgacttcctacaagtctgacttctagagagcaggctggctttctgagctgattactgcagataacaagttggttttctggactggttgctgcaggctgcggggcagttctatttttacgcatagtctgaccattgcccgtttgtatgtttatatatccagtgtctcactctttcctcaaagaaggtggacctggcattttgctgctgaagtccgaaggagaatgcagcatactgtccagcctaaaacacacaccccactagggggcaactggctttagcacccagagcttctccggtggtttgtgacaccccattctgggagccgtttctgagagccacacacagcatgagtgtgagtgccgttctgttcagctgtcagagatgctgattcctgtggatgccactgaaaatctcagcataaatggactgctttccccactccccatagaggagctctgtattcgcagactttaaccctgcaccaagaactctgcactggtcgcaaagtcttccagttctccaaggcttatatgcaaagacccaccccacccccatagtaccttctcccatgacgatcatggtaccaggcccaacaccaaggccacaggggcagggtctagaggtgtccccttctgatgtacagtcaccatcgggctgctaggcttcctgcagccagcaagtgctcactggtgtccagcttggcctcaacatcttccatgagtttcacttattgctaccaactcactgtttgaggctgcacaacaggagacccagctctggtgccaatcagcccccttattcctgtttaaagcctcttgggggaacaaccccagggtcaaagatttaagaaggaataagaaaagtgatgttggcttcttcccataaatgtaccaagagaactcagtggtgtttcctgatgcccagaagctgggtcagagcatgtggcctccatccactgcagacttggaggtcctgggcagatgttcaagagcctgtttccaaagagaatggtcctaatgagtgactgacccactgaacttcagagtattccacctcagaccaaggtggtccaggtagtggcccaggtagacctgcctctatagggatggaagctgtatatctgtgggagactaagtcagacatcagcttgcacccatttagcctcagaggccactgtgggtgcttcctgcctttgctcccctttgacctctgtcccagtgttcctgataagatttcacaagcccagcagctgagtcttgttcttcttatcatctgacaaaccctcttcttgcccctaaggctcagagcacactgaaggctgggagggtcggttggtgatacttactttgattttttagtttaagttctgggctacatgggcagaatgtgcaggtttgttacataggtatacatatgccatggtggtttgctgcacctatcagcttgtcatctaggttttaagacctgcatgcattaggtatttggataatgaatttttttaatgatgataacaaaagccagtttaaatctctttttcaaaaccataatttaattttattcaaaatggtttgctgtatataagaaatataataaaccttgaagaaaacaattttgaaaagtcatctttcttactactctaagcttctatattaagctctagctaccctttagagcttgctggagaagtaaacaagcatccaatgcaaattgggttatacttagttctagttaaagaagaaaaatagctaaaggggacattgagtcatgagttcttctaaaaacaaagaggtaaacacagaaaacttgtaattaggaaatatctagggactttatatgcatacaggcaaaatgcgatactgattagattaatttttttctactgagttttgctatgtagcaaaattcaacctgttgaagtggatgagcagctatgccctgagcaaccacatttacaccagccctggccagcctgaggcaccaacagactgaaatgcagatctgctatgagttctcattgggcttttgctataaaatattcatggtgaattacaaaggatcatttgaatcacaatctctagaaacatgttggaaaggagaaaggcatcaaattgcatcttaggcttttatctttttttacatgccactctaaagtaattacagattattcaggccaatgttaaactcaaatttttaaaaatcaacatttataataaaatgacctgctgatttcttaccctgctcaccatatggtgatttatatggtgcaatgagggcccactactgcctcctggtggtaatgtatcttaattgcaggaaccattttacaaaaaatagttatgctttgaaagatgaaacatgaagttacaaatactgtgacctaaaaaatacagacttgacatctgtggtaggagagatatgcccaaccatccattcttaccatttgagggaacctattgtgagctgagtgttgaattagggaacaaaatttctaccttgaaaattcagtttcatcaatagaaaaattcagattactcaagccaaatgatcaaatgtcactagaaaaggaaacacatagtataatcaggtggtgttaactcaatatacataattttttaacccagaaacacaataacatttttcagacagcttgacataaatgtggacgggacacctacttgatttctctaaaattggtttaaggaactgattgacccatccttcattaatcacccctgagtttttctccctaacaattttggtcatgcaaaatctccagaagtctttgtgccaagtgtctaacccaactctattttgtatacctcaaaatccaattcaaattcaactttcttcatatgatttttctttcccactcagaattaaagtgatttctccttctagcagttagattggcaaaaataaaaactatgatcctgtctacaatagttacctccacccctttatgtttatataatattacaccattgacatcctttgccccacctgtcatggtactttgctgagctatgtgtttgtttgcttactgtgtatttctgccactagaatggaagtctcatgatggcaggaaccttgcctgctctgatactttaaggagcataccaagctcctgaaatactgccgtgcacgtagatgctcactaaatattttctgaatgaactatcagtcagtgttagtgaaggtattatagtcaaactcttaaactttctggtgagaatgtaaaaattattcagaggacagtttgttaatacacatcaaatttcattataaaatataacaattaaatataagaaatgtttgtcaatagaatagaaattatatcaatagtaagctatacagccatcagaaatgatgatatccaactatatttacagacacaaaaaaaggtccttgacatatatttaaaattaaaaagcagagtttgcaatagcatgtgtgatggttaattttaatatgttaacttgactgggctacaaggtgcccagatatttgttcaaacataattgtgggtatttctgtaaggatgtttttgggtgtgattagcatttaaattggtagattgagtaaaagagattgcccaccctaatgtaggtgggtctcaaccagtcatccaagaacttgaacaaaaagactgcccctaccccaaataaagaagattcttccagactgactgcctttgaactgggacattgactttttcctgcctttgatcttgaactgaaacattggctcttccttgagcttgccagccttcagactaaaactatactgtcagccctattgactttcaggccttcagactcgagctggaactaaaccatcagctctcttgaatctctagcttgccaactcactctggagtgagtgagatattgaaacttgccaaactctattatcatgtgagcctattacttataataaatatctttctgtgcatacatatacctcctattggttccatttctctggagaaccctgactagaacagtgtatagtaggatctcattgtgctaaaatattagaactatgtagatctagtttctgtagtgtgcccagtttgttcatgcctccctgtattcatgcctttctatggttcctttcacaatgactctaggcttagtcatgcaacttccttttcaccagtgagacaatagcaaacatgacttaagcaatgacttgaaaagtgcttgcgtattggagttgcctttctgctgctcttgaaacctgagacagccttgtgaaccagaccaagcagcctcgtgcagcaagagaagccactgaagaaaggatttagctctcctacccatgctagtcaagacccatcaccagctcactgcccacacaggaccaagctcagctgaggttgaggggagctgccccctcccacttccctctcacattctgaacaggcgacaccacctctgggtgcatctgacccctcattctcactactgagcacccatggactgaaacatggtggcacattactgcaaatcatgggcaacttaacaccaccattcaacagctgcagtcacctgagactggcctggaccagaactgaccagctgaacccagcccaaattgcaaccttaataattgcagactatgctgaattttttttatcttgcccaaattcctatctaaggggtctggggagtcataccctacaaactataaattctcaccagatgggttttatttaaccctatatatcgtgacttactttccaaatccaatatggcatataacactatgtgacaaagaagaaagtcaacatattttatcccaaaacatgtttctttgccatattttaaaatggtcctgcaaagctgtcctttctgggtaaaaatgtacatttgtaaagaatctctattaacatagctagatctttttcttccaggcctcccaatcctcaggagattaagtaggagtctaacaccttttacaggaaacatttgtcatctattgtctctaagggcagccactgtaagacttcaaaagaacccaggtctccacaatcttttattttaacctgaaggttttctttctattgatcccaggtctttagacaaactcaaccaattgtcagtaggaaaatgtttaaatttacctatagcctggaagcccctcccactttgagttgtcctgcctttctgaaccaatgtgtttctcaaatgtaatttgattgatgtctcatgcctccctaaaatgtataaaaccaagttgcaccccaaccaccttgggcacttgttctcaggacctcctgagggctgtgtcacaggccatggtcactcatatttggctcagaataaatcttttcaaacattttacagagtttgagtctttttgttgacagaatcatttattaaatggttagcatttcaagccactaagctttgagatggtttgtaatgaagcaaagactaactgatatgttactatagaacaacaacaactaaaaaaaaaagcctagaaggctatatcctaaattgttaatagtggttacctctatgtagaaattacagatgacttctggttcattctttttagcatctctgcatactgtttataataagtgcatattatgtctgcaagcataaaaaacaattaaaatccatttcattttgaaaaataatttttaaattgatctctcccttcttagatttcctgcagtaattactgtttgcatgactaattcaccaattaaccatgaagtgttttgatatcaaaaactgatatttaaggctttcattgttatttgactatggcaatggaacatgcagtgatactttttaaaaatgctgtgtatcatccatagttattaagcctatgactggcatacagcatggagccaccaatgatattatttactttgatttgaaatcactgttttgtattaacaaataaggcagagtaaagagtagaatatctgcaagaagaggagaggtcctggcaatggcagtgtccaaaataaacctgagttacctgaaaactcaacaccaaagcatttagtgcccacttgcaactgcctatgccctgtggtaagagtggggattcctgtggccatgccacgattctctgctcaatgtccaatttcaagcttaattcagattgatttaaacatgcatatacatatctaccagagaattaaacaaaccatggaaatttagaatacaaattaaaatttcttctagagacctaatctggaaaaagaatagtatttgaaaactagtaaagcaaacaatgtagaaaaaatggcttaagcaaaaagggttcagatgtgaaagaaatcatccttaactaactttccagaatttaatttttaaagaatatggccaagaagtcaaaatttattcacctccatcgaagttgatgaagaaatgtaagaaagcaggtgttatgtagctttatttgatttttcaaaaagactccatgtaaagctttaagagagagaacaaaatagtagatgacaaaaactaagcaaatactagattaagaaactaaagtgagcctcccttgccttcaactttgagttagcaaggagagtcactggctccttcaaggagcactgccacgcatcataaagctaagtggctctgacaaggatctgaacaacagggctctaaaatctgctgacaacactaaaatgggagttgcaaagaagaatgaggagctgtgtgaccaggtttaaaggaatctcaatcatttaggtaattgggccagcagatggcaaatgcagtgcattctggaagactgtgaaataattagtctgaaagacagaagctaatctagtaataatgatcttccatttatgtagcattattttttacaaagcacctttcaccaagtggttcccatagtgccttctgtaatgatcatgcatggtatgttaatgtgttcacagtgatagaacaggcactcttggtggaacagtgtaatctgcacgactgtcgcccagaagagaaggtgatgcccgaaggagaggtgggaaactcccaaggtgattcgccaaatagaaataccttttggacactaaggttagagaactaaaccagcaggatgtttgcttgaatttgaatgatgactcatgaaggatcagaatgctatttccttggggtgagattaaaaaatatgtgtgtaccaggatttagaggtttatctctaaataaaggctgaaagaatttagctttatctttctaaaatgataaaagcaccacacatctttttttaaaaaaacaacaactactttcagttagccaagtgaaacttttcagttttgtaaataattcccaaggttaaacaggaaacatgctgagtagttcaagggagagtggagagaacattgtttcacaggctgcatttgcttccctccctcagaagcaaacctcttctctccccctctactccccttcttctagaacttagtcaaagcagagtttgtaggatcaatatggccaggggctgccatattgatcagagcagctctagagagtgaatcaggctgtggtgccctagaaagaaatatcagaaggtctgtttccaatgtcctgtgtgacctgaagctcttccttctctaaatcattattagccataaacgttcactgcagatgatcatttcttaatcagaaaaatacttctttactgcacttggctcttttccactcatgctaacagataccacatttccccatgtccctttctccctggcataaaacacacctttcctctacctgtgcggaacagcccatgcttcctcctctgccctgccccctcccacttccctctcacattctgaacaggcgacaccacctctgggtgcatccaacacctcattcgcactactgagcacccatggactgaaacgtggtggcacattactgcaaatcacaggcaacttaacaccaccattcaacagctgcaagcaagccattccaagcagaggaattctcacagtcacggtgcttcaataacgcattagagctttttgagtttcttgtctgtcttacagttgttgttatttttgtgttagctagcaaacaaagctacataaactgttatgaaaagtatgccctctaagacctgcctaattttatctaattccaggatcctaaaaatttttctgggtgtgaattttgttccattttcttccaggaaagtctaagagtgtgttacccaaatagtgctccaccaggagaaatccaaagctggtaagatgtgcctgaggatctggcaaaaatcagcatccatggtcttggggattgcaaatattctgcttgcagcctcttcgtagattcttttacagatggcaattttatattgctttacactgtaacaagaaggaaataaatggggctcttatacttctcctcttcactgatgccaggagaacatagcctctggttcccaccagcaggaccttctcactgttcttggcacaagaagatgccagcaagtaaaagttgctaagcattgcttttagattgaaaataagatgcacatggtaggtttcactgcatgacttaagcaaagtgccaggttctgttttcttttaaatattctcactagagggatgggagaggggagaaaaagtgtcagaataatctacaaatcaaaatgctttttaatggggatgtggaccacggctttcctttgctggtttcatgaaacctttgcacactcaggagaagaatgcatgttagctggtatgagcgctgctggcagtctccatggagtggggatggaggagtgcagattccttttaaaacattattgaaggttcttctcagccatccacaccacacattgatcttctgtcacagctctatgtctggagggctggtactctccattgatccacagagagcatttttagtgcatcaaagaaatacagaaggtgggactcagagggaaaatcaggaaccacacttttagtgctggacacagctcagcagtataaaagtcacataaaatattaagctgaacttgagatttttttttttaatgttgtgaaatctgttgacatatgagactcaatgggacacaaaaaacggaaaggattaatacctcttttaatggaaaaatctcccctgacggaacagaagcaagccctaggacctgataaactgaatcccacattcatctttctgcaaaggaccttaggttgtaaatcacaagtgtctaggctgaaaagttcaatcagtcaagatgcggtggtaatgggtcaaggtcatgcatcaatccaaagacagactggttagttttactccacagtcaaaggttatgccccatccggatgataaaatctgtgctcttctcaggagcaaggaggtggctggcctgatagagcctgtcacagcaagggacaaaactactataaagacagagcttcccacccaagccagcatgccagccacccatggaagtcctacctgtgccacaaggtcagactcagggtccctgtttcagtcagcttaggctgccataacagaatgccacagactgagtggcttaaacaacagaaatgtattttcccataattctggaggctgaaggtcccagatcaggatgccggcggggttgggttctggtaaatgccctcttcctggcttgcctttcctcagtgcaaatgcatggagagagggagaaagagatgactcttcctctttttttttttttttttttttttttgagacagaggctcactttgtcgccaggctggaatgctgtggcacgatctcagctcattgcaacctctgactccctggttcaagggattctcctgactcagcctcctgagtagctgagattacaggcacgtgccaccgcacccggctaatttttgtatttttggtagagatggagtttcattatttggccaggatggtctcgatctcctgacctcgtcgtgatccacccatctcagcctcccaaagtgctggaattacaagcatgagccaccgtgcccggccaactcttcctcttcttataaggctaccaatcctagtggactaggtcccactcttatgaatttgtttaaccttaattgcctccacaaagtccagtctccaaatacagtcacactaggggttaggccttcgatatatgaatctaggaaaacacagttcagtccatcacactcaccttccatacacagccttcttttacctccctaatcagacataatatgccctggggaaaaaaaaaaaaaagatgaaagaggatattttttctttgagggagacattttagacacttttacctaaacctttttctaaatactgaaagagttgaacatgtaaatcaataatgaaaagataacctgctcatatccaagtggacaactaactcacgaaggctatgggacaaaaagcaaggtcaaaagaagacaattcttatgaatttgcagatttaagcttccaaaatggtgaattgcacaatctctgacagaacagattctcagtgtctagtgaatggacaaatgaatacatgaatgatggatattttctgataatgagaagaaactaatataaattaaaatcaaagtcagaaatggcctcatcaatgcttattcaaggctaaagttgactaaaatgactacccctttaaaatcaggatttcaaattataaaactataacatttcaaacacagataattacatttcttatcaaatgcatgggttcttgtaaaataattcagtttaatatatacccaatttaattaaaatttataagtggttgtggactaaaccaagtgtatcttaattaaatcagaacatggctcacagatgttaaggtcaaccccagttttaataaagaagatgcaaatataatcattagggacttggctgagtaattgtggtcaggtggaaagtaagatgaaaggaaggccaggaagaccccttctactcaaggctaaaaagtaaaacgacctacggagtgcaagtgcagaaagatggggttgcctgctcagtgagccgctgaaatggaggtaggaaattcaggtatgaaaaaccaagtcaacaatcaattaataaacttacattagataaggaaggaggaggcactttctctgacagttcacacatcatggaaggttgcaatgggttctgctatcaccaaaacaatcagaaatggaaacaggacattcttagagccaacgctaaagcctgaaggattgcatgaataaggttgacacataaaatacaaagttttcagttaaatcagaatttcagataaacaacaatttttttttttgctaaaagtatgtcctatgcaacatgcatcctgtattgtcttttctaaatttggcacctacacgtgaacttaggcctgtagcaaaaggcttatcaaggagctttctgtaattccaatataaaccacaacatttattgaagaattatcattaagggctgaccgaagtcttaaaatagaaagtatatacctgaattacactgtaggctcattgccagctcttggaagggatgcggagagacgatctaaattttaacattcgggtcattcctatccacctgcctgggagtccttcttctgaatgtatctccctcagatcacagcatactctgaggaatgtgtcagtcacagggagctatgctggtcagaaaatcaatccagaaatgttgatttcaggtctcttccgtaaacagaactgtgctgttaatcaaaacccaacggcacctctgcacccctggagactctgtgggcagatgaagaaactgaggccctagacggtgaaatggcttttccaaggtttagctgggtctccctggcagagctaagactagcaccctgctattgtaaatcacctttccatgagtctttcagtaaggaataaaacttataagtgctattgaagctcagaaatatatatatataaattttatatattatatataattaataatatatgttaattatataattaataacatatgttgattatataattaataacacatgttgattgtataattaataatatatgttgattgtataattaataatatatattaattatgattaataataaatatatattaattatatgattaataataaatatatattaattatataattaatatataaatatatataatatatattaatttcttgctctttggatgtttaggaaaaaaatttagataggtgaagatatcactcatttaacagtgtctattcactgtcaacttcatgcccagcactgttgtggatgctgggaccactgacacaatgctgccctataaggagatttagcagatgctcaccacagccttccccacctcctgccaggcacaaccagactacatttcccaacctgccttgcagctatatggccatgtgactgagcactagccaagggaatgtgggtgggagtgatgtcagatattcccaggccaggtctattggaaaccttctgcattagtcagagctcccaagagaaaaagaaccaagaagagagatggagatggagatagagaaacatgaagagatccagagatagagattgggagatgtaaaaagattataaggtattgcctcacatgattatgaaggcagagaagtcttaccatctgctgtctgcgagctggacacccaggaaagccggtggtgtagtctgaaggctggagagccagagagctgacagtgtagattgcactctaagctgaagtcctgagaacaagaagcatgagagaaaaagaaggttgatgtcccagctcagacagttggttagaatgggatttcaaccttcctcaggctttgtgttctgttcaggccctcagtgaattgaatgatgtccacccacatgggagagagcaaactactttactcagtctatggattcaaatgctcatctcttccagacatcccctctcagacacaccagaaatcatgttcaaccagctacatggacaccccatggtccagtcaagcaaacacctaaaattaaccatcacaccctccatgtgaaaggaggcagaagatccagcagaaaagtcccaggcctcagaggaaggaggactcacaaaacgtgtccgtgaatcactacctggaaggctgggcactagacactcacatagagctgtcatatgaagagagaactaatcttctattgtgtgaagtggctgaggtgtaggagtcatttgttccaggagagagacaaccatgatacacttccctggtggaacttagagaaaagacaggttctgggcaaatacacaaacaaaaacagatatgattgcaacttgttgtgagtgttttgtagaaacaacatgagcacaatgataaagaaaagctgagatgcaagaggctgctctgataggtttggacatggctggtaatgagccaactacaataagaacggtgagagtaatagcagatgccactacagtgtcctgtttgtggaaggccctgggataaatatttcatgcactgtaacttatttactctcacaacaacctgtgaggtaggaattattatcatctccattttacagataaaagtaaggattcttgaagccacctatactatttcattctcatgctgctatgaagaaatacctgagactgggtaatttataaaggaaagaagtttaattgactcacagttcagcagggctagggaggcctcaggaaacttacaatcatggcagaagaggaagtaaacatgtccttcttcacatggcagcatgaaggagaagcaccgaggaaagagggaaaagcccctgataaaatcattggatctcatgagaacttattattacgagaacagcatggagggaactgcccccatgattcaattacttcccaccaggtccctcccatgacatgtggggattatgggaactacaattcaagatgacatttggatggggacacacccaagccatatcaccagcatatttttgattggtcaaagcctgtactatacaaactgttaagtctttattattattattatactttaagttctggaatacatgtgcagaatatgcaggtttgtgacataggtatatatgtgccatggtggttggctgcacccatcaacccatcatctacattaggtgtttctcctaatgctatccctcccctagtcccacaccctctgacaggccccaatgtgtgatgttcccctccctgtgttcatgtgttctcattgttcaactcccacttatgagtgagaaaatgcagtgtttgactttctgttcttgtgttagtttgctgagaatgatggtttccaacttcatccatgtccttgcaaaggacatgaactcatccttttttatggctgcctagtattccatgctatatatgtgccacattttcttaatgcagtctatcgttggtgggcatttgggttggttccaagtctgtgctattgtgaacagtgcagcaataaacatacgtgtgcatgtgtctttatagtagaatgatttataatcctttgggtatatacccagtaatgggattgctgggaaaaatggtatttctagttctagatccttgagaaattgccacactgtcttccacaatggttgaactaatttacactcccactaacagtgtaaaagcgttcctatttctccgcatcctctctagcatctgttgtttcctgactttgatcaccattctaactggcatgagatggtatctcattgtggttttgatttgcatttctctaatgacaagtgatgatgagcttttttcatatgtttgttggtcgcataaatgtcttcttttgagaaatgtctgttcatatagcccactttttgatggggttttttttttcttgtaaatctgtttaagttccttgtagattctggatattagccctttgtcagatgaatagatggcaaaaattttatcccactttgtaggttgcctgttcactcttatgatagtttcttttgctgtgcaaaagttctttaattagatcccaatttgttaattttttatttgttgccattccttttggtgttacagtcatgaagtctttgcccacgcctatgtcctgaatggtattgcctaagttttcttctagggtttttttatggttttaggtcttatggttaagtctttaatccatcttgagttaatttttgtataaggtgtaaggaaggggtccagtttcagtttcctgtatatggctagccaattttcccaatgcaatttattaaatagggaatcctttccccattgctttttttcaggtttgtcaaagatcagatggttgtagatgtgtggcatgatttctgaggcctctgctctgttccattggtctatgtatctgttttggtaccagtaccatgctgttttggttactgtagccttgtagtatagtttgaagtcaggtagcatgatgcctccagctttgttctttttgcttagaattgtattggcttatatgggctcttttggttccatatgaaatttaaagtagtttttctctaattctgtaaagaaagtcaatagtagcttgatggggatagtattgattctatatattactttgggtagtatggccattttcacaatattgattcttcctatccatgagcatggaacgttttttccatttttttttttttttgtcctctcttatttcattgagcagtggtttgtagttctccttgaagaggttcttcacatcctttgtaagttggattcctaggtgttctcttctccttgcagcaattgtgaatgggagttcactcatgatttggctttctgtttattattggtatataggaatgcttgtgatttctgcacattgactttgtatcctgagactttgctgaagttgctagtcagcttaaggagattttgggctgagacaatggggttttctaaatatacaatcatgtcatctgcaaacagagacaatttgacttcctctcttcttatcagaataccatttatttctttctcttgcctgactgccctggccagaacttctaatactatgttgaataggagggatgagagagggcattcttgtcttgtgccagttttcaaagggaatgcttccagcttttgtccatttagtatgatattgactgtgggtttgtcataaatagctcttattattttgagatacattccatcaatatctagtttactgtgagtttttagcatgaagggatgtggaattttatcaaaggccttttctgcatcagttgagatgatcacgtgttttttgtcactggttctgtttatgtgatggattacctttattgatttgtgtatgtggaaccagccttgcatcccagggatgaagctgacttgattgtggtgcataagctttttgatgtgcttctggattcagtttgccagtattttattgaggattttcacatcgatgttcatcagggatactgacctgaaattttcttttgttgttgtgtctctgccaggttttggtatcaggatgatgctggcctcataaaatgagttagggaggattccatctttttctattatttggaatagtttcagaaggaatggtaccagctcctcttcatatctctggtagaattcagctgtgaatccatctcgacctgggcttttattggttggtaggctattaattactgcctcaatttcagaacttgttattggtctattcagggattcaacttcttcctggtttagtcttaggagggtgtatgtttccagaaatgtatccatttcttctagattttctagtttatttgcatagaggtgtttatagtattctctgatagtagtttgtatttctgtggggtcactggtgatatcccctttatcattttgtattgtgtctatttgattcttctctcttttcttcttaggggcagctgttggtgcagcttcagcaggcttaaactttcctgtctgctggctctgatgacagcagcagatctcccagcacagcattcgagctctgctgagggacagactgcctcctcaagtgggtccctgactctcgtgcctcctgactgggagatacttcccagcaggactcaacagacacttcatacaggagagctctagctggcatctggcaggcccccgtatgatgaagcttccagaggaagaaacaggcagcaatctttgttgttctgcagcctccgctggtgatatccaggcaaacagagtctggagtggccctctagcaaactccagcaaacctccaacagaagggcctgattgttagaaggaaaactaacaaacagaaaggaatagcaccaacatcgccagcaactggacagagaatgagtttgatgaattgacagaagtaggctttagaaggtgggtaataacaagctactccgaactacaggagcatgttctaacccaatgcaaggaagcttagaaccttgaaaaaaggttagaggaattgctaactagaataaccagtttagaggagaccataaatgacctgatggagctgaaatacagcacgagaactttgtgaagcatacacaagtgtcaatagctgaatcagtcaagtggaagaaaggataacagagattgaagatcaacttaatgaaataaagcatgaagacaagattggagaaaaaaatcaatgaaaaggaacaaacaaagcctccaaaaaatatgggactatgtgaaaagaccaaacctgcatttgatgggtgtacctgaaagtgacaggaagaatggaaccaagttggaaaacagtcttcaggatattatccaggagaacttccccaacctagcaaggcaggccaaaactcaaattcaggaaatacagagatcaccacaaagatactcttcaagaagagcaaccccaagacacataatcgtcagattcaacaaggttgaaatgaaggaaaaaatattaagggcagccagagagaaaggtcaggttgggttgggggatgagtggtggggagtattttaggtagagcagtggttctcaattgagggtgattttaccatgcaggagacatttggcaatgtttggcaacatttttggttgccactacttgggatgagtgtatgctaccggcatctggttagtagaagccagggatgctgccacaaattctataatgcataggacagtgtccctcacaacaaataattatctagccccaaatgtcaatagtgttaaggtggagaaaccctaggggagagtaaaaagtatatgcaatgcccctctattaatcaattttgttttgctataaaggaatacctgagactaagtaatttataaagaaaagaggtttatggggctcttggttctgcagactgtacaagcatggcatctgcatctgcttggcttctggtgaaacgtcaggaagcttacaatcatagcagaggatgaaggtggagtaggcatgtcacatggcaagagagggagcaagaaagagaggaggtggtgccaggcccttttaaataaccgggtctcacatgaactaacagagcaagaacacactcattactatgagaaggtcaccaagctgtccatgaatgatctacccccatgaccaaaacatctcccactaggcccatctccaacactggaggtgatatttcaacgtgagatttggaggggacaaaatatccaaaccatatcagccacccctataatggcaaagccccagtgtggctggaactggtatacatcagatggagcatacatcagatggagtggcaccagatgatgttggcaaggtaggcagggttaagagcacacagaggagcccttgtaagatacagtaggagttgggattttacttcagatgtagggggaagcataatggaccactgatgactgctatagaaaatagaatggagaaggagtcaaaagataaaaaagctgctctgtggaccagtgagatatgaagagggttagaacaaaacgtgatggcagaggtaaagtggatagattggaacttcaacttggagctggaaatggcagaatgtgttgatggcttgcatgggatggcgggctggggaagagggaggaggaaaggatgatgctccaggctctggcttcaacaactgggtgagtggggttgtcatttactgcgagtgaaaagagggagaaaattgggaggaggtcatgacaattctgaaaggcctgtgagcaagcacacagatatgtcaagtggatagttgaatgtgcaggtcttgggttcacataaaacatatgggctgaagatttatgtgggaggcatgaggatataccagctctcccagggatagagaaaggtgacccaagatgagccctatggccctcaaatatttacagttagggagaacaggaggagccagcaatgggaaaaagcaaaggccagatctgaagacaatgtggattgtgattatctggaagagagaatgcctcccagaagaagagagtcatcatctaccccaaccatagcgagaagtgaaataaaacacaatatgaaggccattggtgaccttgaagggcacagtctaaaacaaaggtcagagtaaaagtcagattaccagggcctgagatagtaagcacagacaatatgtgcacagaattcttttgagaattgagaatttttttgctgtgaaatggagcaaaatgatagggtaattgctggaacctgaaggggtcaaggaagatttaagaggatgagaaaaaccactgcctgtttgtaagctatgaaaaatgatatagcagagaaaaactgatgatgcaggaggaaggggaaggaacaagaagcagttaaatccttgaaaagatggtaggagtggtggcttccagagaacacagacctggagagggagaaaggagaagtattgtacttccagtgcagatgggttcctaggtttgatgctgctaaatgaagatgtgtccatctaactcctcctatttgcacagctaactcacatttagctgatgacctggttgtgagaaggacagaaaggaatagggtgctgggaggtttgaggagaaaaattgaagcatgaaatagttatcccaaagaatgaagagcaaatattctgggagttgtgaagggaataggtttgatgggcaatgttggaaactcatgagaagtttgagaccatgagtttgaagtgaagagccagccaacttgcctgaagtcctacagcaacatttcatgtttcagacgcagacctagacaaagcaagtgctgcgggttctccagtacacactcaacccccttcaggatatggcactcactctcccactgaccagagcactgcctatgggaggctcatatctgagtccccactatgggaactgcccatgactgaagggagccgtttctccaggtcatggttgctcagggaaaagaaaaaaggccttcttacctccatgaagagatactcagggcgtgacaaggttcaggctgtacccgttagtgtgaagagagccacactttctcaaaggaagacaaaaggggcaagtcatccattttattagactaatttttagagcggttttgtgttcactgcaaaattgaacagaaagtacagagagttcccatatatccctggtacccctccacacacagcctctcccactatcaacatcaggcaccagagtggtacttttgttacaaaaataaacctacacttaacacatcattatcacccaaagtctacagtttacattaggattcactcttggtgttgtacattctatgggttttgtataatgacatctatccaccattagagtatcacatgcagtaatttgttactgcatatgatactctattactctattatgcagtttattactgcatatgatactctgtgacatccaccaattttcatgggttactatattcatttgctaggtcactcataataaattaccacaaactttgtggcttaaagcagcagaagtttattctctcacagacagaatccaaattcacagaggccatccaaaatcaaggtgttgggaaggtcattccccctcccaaagctctggggaagaatctgccctttgggtcttccagtgtctggcggccactggtgtcctctgtattctttggcttgaagacacaatctctgcctccatcttctcaccaccttctcctctgtggctgcttctccttggtgtgtctcttataagcatccacccagatataaagacccaccagatagcccagataaatcatgtcaagattcttatttgcacctgcaaagatcctttctttaaataaggtcacattcaccaggtttcaaggattaagacatggacatgacttattagaggtctctgttcatcccactgtagttactcagaggtggggcagagctggacagaaatatctctggccttctccacaaatggagagagatgaggatactagatgctgggcatgagtgagaacagaggccatgctgggctccattaataatgatgggtgaggtggggaaactggagtgcatgatgataaattaattaataggtacaatgtacattatttgggtgatggataccctaaaagccctgacttcaccactgtgcaatctatgcatgtagcaaaattgtacttgtatcccatatgtaccccatacccattttttaaataaatcaattttaaaaataaaaatgtattttaaaataatgatgatgaagccagtgaggagtgcagtggcggttcagaggggccttattttgatcaatacttgagaattaagatctgctccctcacgctcagcccctcaacgctgttctcagtgacttgtgttaaaccttattgccagagaataaatgaaccacaaccaaacccggagtagacccagctgttccagtaattttatgccagcaccagaaccacaaagctaagaggaagagaaaaggcttcttgctttcctgtgacattttattttttattatcatttattattattattattgagatggagtctcattctgtcacccaggctgaagtgcagtggcacaatctcgtctcactgcaacctctgcctcccgggtttaagcgattctcctgcctcagcctcccgagtagctgggattacaggcacctgccaccacacccagctaatatctttattagagatggggtttcaccatgttggccaggctggtcttgaacttctgacctcaagtgatccacctgcctcagcctccccaagtgctgagattacaggcgtgagccactgcacccagctcctgtgacatttgaactgtcagtgagaaggacctctgctctgctgtgaaaggttcaactattttaaagctacatgtcattttttattttttattcatacataatcaacattcatgttttcaggtatgtgtgatcatttaatatattcaagtaatttttaaagatcaaatcagtgtcattggtatatccatcacctcaaatatttgccttttccttatgctagaaacattccaattattctctgcttgttattttgaaatgtacaataaataaagaaacttgtctatgttgatatctactcccaatctggggacagacatgctcagggtatattttctttcactaataaaaggtggattaatttttctgtgaaaattcttctttaaagtttactgcttctaaaagcatggaattttatttctctggtgatcagtgatgttgagcttttttttgtatgtttgttggccgcatgtgtgccttcttttgagaagtgtctcacgccagtcagaatggtgattattataaagttaaaaagaaacagatgctggcaaggttgcagagaaataggaacacttttacactgttggtgggaatataaattagttcaaccattgtggaagacagtgtggcaattcctcaaagatttagaactggaaataccatttgacccagcaatcccattactgggtatatacccagagaaatataaatcattctattataaagatacatgcacatgtatgtttgttgcagtactattcacaatagcaaagacatggaatcagcccaaatgcccatcaacaagagattggataaagaaaatgtggtacatatacaccatggaatactacatagccataaaaaggagtgagatcatgtccttcgcagggacatggatgaagctggaagtcattatcctcagcaaactaatgcaggaacagaaaaccaaacattgcatgttctcacttataagtgggagctgaacaatgagaacacatggacacagggaggggaacaacacacattggggcctgtcaggggagtgtggtgtgagaggcgagggcatcaggaaaaatagctaatgtatgccaggcttaatatctaggtgatgggttgacaggtgcagcaatccaccatgccacatgtatagctatgtaacaaacctgcacatccggtacatgtaccctagaacttaaaacttaatttagtttaaaagcatggaagtacagtcggccaccaccacccacccagccaattttcaatcagattcatctccaaaccacctggggtctgttgctggaatgtggggtgcattataccagagagcagagccacagacagcactggctcccctagtcagccctcaaagccattgtcttaaagtctaattggaattgtttttagaaaagagaattttgcaattaaaaaaaagtcatgaatacaggtccagcagtcatgactaaaacatcaaaacagtcatgtagaaaacacagaaaagagcgtcttgttaggtctcctgaatagtgactgaggagagcctgagtgaaggaacctgagaggggagagaggcccacgggatcctgcaggtgatgtctggctctcccgagagcccacggtggacggtgctagctcactttgtcacatttttcactccgggaaaggggtggcaagcaggacccgttgtcacccggtgtcttgtccttgtttgttttgtggtttgggttttggttcaccaagagaattatgaaagggagagacaggaaaatatccttgatgtgcctgagcaaaattatagaaacaagagcaggggagggtgagggagttcagtagagctgaaagaggttgcagcagctggaaatccccgggctgcagggtagaaggaggtgggagggagacgctgcagaataccaggcccctcactggccctgcaggtcccctcgctccagcctcccaaccctgcaacctgggatgagtgtccacatctgacagccactgagaaggcgggcctggcaaggtggcccttgtatgtattaatacatggagtgggcacctctagaagtggctgtgatatgtgggaagggtcacgtggcagagatgaaggtgtactgaaagacagcacgggaggctggctctgcacattcctacccgaggatgaatgcaagggatctgccttccccagagccagcaccctccgtgctccaccttctgcttgggggaaggggtgcctgtaacatcctggaccattgaaaagggaagctaagcacacataacaactcagatgggaaaaagcaaatcacagggcttagatggacctcatcctacagtacaattaaatgacatccaaggatgagcagaaggacaagacacagcccttggcactgccttcatgtggggcccactccaatgctgacagtctgcaagggctctccagtgagcactttgctcccagagctctgggcagagctcactggactggactgattcctgtccttgccacccacagctcctcccaacccagtcctctgctccttggaccactgagccccctgtctgttcccattccctccaatccccctaccctgcaccttctactgaaatcactgaatctttatccagtgggatgacaaggcatctggctctattttcctccaaatccaatcttcatagcgtaaatgttatgaacacaggaacttctttagcttttgatagtcaaagacaagttattgaatctcaagcaccatttttgctttcaaaaagcccaattcttgcaagtcaatagtttggatctcaagactatggtcacttcataaactccaaaaactatccaagaaactcatgatgagacatgacttcattatctgtgctgttcactgttcatggctattatgggggaaggaggtggccattaccaccttcatggagacctaagatcaaggaaacgcgggtgtgagaagcatcaaagtgtttgtgtttgcaggtgtattaccctggctaataaatctaaatgttttcccaataaagcagttgggtaacaactacaaaatattttatatgcttacagaatgtccaagatgtgtgtaggtgtgaatgtgcgcatttgcctataacacagaggtatcaccttagactagtagatgactgggccacagggttctgacaaacttatgggttttttaattatccaagtgttcttccctgaccatgtgttgcaataattgttagaaatatataataaatatacattttaaaagagtaaacaacagaaataaaataaaatcattaggtgtttttgaatcgcatttttgtggcagcccaggaagctgacgctaactgactggccagcagatgtccagggtgaaagacaagctgggccattggccctctgtcctgtgtcatttccaaggctcaggccatggcctcacacagagagctcccagcactcccgcatctttctggctctctctaaagagctgattcctctgaaaattccccttcccagggcttttgtgccctcccttctccaagttccagttctagaagataagaggtttccagaatccagacactttgagaatcctgcagtgctgtcagaggcccaaaatgtcatcctctatccagctgtgaacagaagattctcgaacacctactcgccttgcccactctcccagaggagatgacgccccttccagactcagttgagtctggagcctggattcactctgcactccacccagtctaagaatctcctagtaaggtaggctggacagtggcccctcataaggtccatgtcctagtccgctagccctgtgaatacattctgccaataggacactgcggatgcaactcagcatcttgagatggggagaggatcctggattctccaggtgggttcaacttcatagcacaggtgtccttgtaagagagggctgaggaagaaacggtatcacagaagaggaaaaggtgaggtgaccttgaaagtgatggaaatgatgcacccagcagccttaaaagtgggaaagatgaggaacagatcctcgctgaagcctccacaaggagccggccccgtcggcaccttgattttaggttagcgagacgctgctcagagttctttaaactactatgtttgtggcaatttgttacagcagccagagagcaacccctccctcccatccacccctaccctgttctaattggatgatagctggagtctttcaggagcccttgtgttttataacccagtggccacagtgaccctaggcgaggccctggtccttcaggctgcatggtcagtatatgtgctgcaggcccggggtccacagagggcactaagtagggagcaagacattgtttgttttttatttcacttgcttcccaagcaggaatttcaatgctgaaatcctatcatcactatagagaagctgagtgtaagttctgttggcagcaaaaattagcaatcagtggctactccctactcagagggagcagacaagttcaaagtcagctgtgcagaaagaagtcacggatggctagggatgctgggcttagatgtggctggctccagttctggtcgtggctgtcctcgtgacccatccagtatcatgcaaggtaacctttaaatagtttgcatttccagcttttcaactgtgtgatcagaatcagttatgccttctctccagaggtgctgcaaaaccagttacgttaagtctgtgctaattttcacactgtttgtaactagccagtgactcaagtacagcctgataagtgggggttgcaaacaccctggagcgaggtgagtgagcaggaccattgttgcgtatttcctgaaacatgcatatttgacatgtagcttggcaatgcagccaaagacaggaaagcaagactgctggctcatatcatactgcccagcacactctgcttcagtgtcttcaaaatgtttagctaaaagaaaatttcttcaaggtgaagcatagatagaagcccaacatgaaaaactggtaaatgtggcgtcattcacatcgacatgaggagcagatcttgagggcggcccagggcccctgcaagccgccccaagcaacttcgtgaaaaacctagaagctcccaggggagctcagcttggcaaccactgttccaatccatcctcatggctgttacagtcagttggtcccatggactacagagtgttttaatgaaaactggacctttcacatgaaaaaaacagaggcccagaattatcgtctcactgggcaaatgtcagactagtaccagagcatgaattgtggagcagacgggaatgacgaaggtcctataaattgggcccctttttgacatcactgcatcacctgacctcagccctgtgctatttatatcaaaccacatggcctcttccagcttcccgcacaatttcttgctttcctcccgcattccagatttgcccctttggagttaaccccttcaggcctctccttgctgcttctttcataaccagcttcatacagtcatttgcctaaaaaatctgttactgctaaagttacctccctgtcaacgttccataattacagggcaatagaaaataaacactactatatcccaaaggcaacctcattcaatgaccaagaaaaggccagagaattaaagaaaaaaatctagaaaacaacacaatttataaaatgcctgggttgtacccatgaagagcttttaatatatgcagattcaacagtggggcttgaatcatttctgaggtgcattctgacacctggccacaggtcctgttgctgtccataccctgctggtcagaaccaccgagccctctgctcgttacatccccttgcctcccctccgctgccacccagttctagctgcatggatagtttgaatttggctcctgtgtggcagcagagggacactgcaggtgtggaaaagagatattcaaggagaactccagctgaggatgttggctggatgcagccagaagatagcaaaggctgaaataaacaaagaccagcaacagagagcaggcacaggctgtttactcattacttatagcatgggaggcagtagcagtcagtggtgtttggcagagactgaagggaggcagaggatcagggaagcttcacagtggcaaagtgggaggctgcaggtgtgccctgagtggaggctgctggctgggggaagctgcaggtggggttcactagaagccaggaatcccatgtgattggttaggggagcgaacgtggctttctctggcaggtcctgagtcggaagtaggggaaaaaattagagttgtcagtgatgaatcaagtcctggccacttggggctggttgctacaggtgctattgtttggctcatttggtggctagaggcagcaatctgacttcatgggctggctgctgtagatcagtggtccccaacctttctggcaccagggatcagttttgtgaaagacaatttttccacaagacctgggcaagagtggggggatggggtgggaggggatggtttcaggatgaaactgtttcacttcagataatcaggcatcagattctcgtaaggagagtacaacctaaatccgttgcatgtgcagttcacaatagggttcatgctcctgtgagaatctaataccaccgctgatctgacaggaggcggagcccaggcagtaatgctcactcacccaccactcacctcctgctgtacagcccaggtcctaacaggccacaggctgctgtgggtctgcggcccaggggttggggatccctgctgtagataatgagttggtttcctgggcaggtgatatggtttggctgtgtccccacccaaatttcattttgaattcccacgtgttgtgttgtgggagggacccattgggaggtaattgaatcatgggggcaggtctttcccatcctgttctcgtgatagtaagtctcacaagatctgatgtttttcaaaagaagagtttcccttcacaagttctctttgcctgccaccatccacttaagacgtgacttgattctccttgccttccaccgtgattgtgaggcctcctcagccatgtggaattgtaagtccaattaaacctctttcttttgtaaattgcccagtctcaggtatgttgttatcagcagtatgaatacagactaatacagcaggtctttacagattgcgggctagagttctgttttcacatctggtgtggccttatccattcatatattctgtctctccagcagtaaaccaagcagtttcagcctgttccagccacatcagcctgcagtggagcagtgatggcaggtgggggttggggggagggtagtgaattgaatggtagtcccccaaaaagatacattcatgtcctaatcctcagaaccagtgaatgtgatcttatttggaagaagggtcattatgatgtaattaagttaaggatctccggatgcagttatcctgattcatctggatgggcccttaatccaacaacagtgtccttaaaggagacagaagaggagaccaagagaggaggagaaggctacatgaagacgaaggcagagattggaataaggcagctatgagccaaggaacacctggagccaccagaagctggaggaggcaaggaaggattcttcctagacccttcagcaggcctggccctgctgatgccttgatttttgacttccaggctccagaactgtgagggcaacaaacgtctgctatgatctaccaagtgtgtgctatttgttatgcagccctaggaggctaatacagcagctcctccacacatgcacattatagctttgttcctccagtcttgccctgcctaagggggaagactgcggaaagaggatatttcctagacttggttcaaataaccaagatattcagaagaaaattgaaaaattcaaacactcagatattttagagtgactttatgttttataccatgaaaacagacatccagatttatttttattttctcctagatatttgcccttttggagatctagacttcctttggtatgtggtcaacagtcccttgaaggtgtatctgtggctatttacctaaatacacacatcagatagtgtcattcatatgttggtaattaataataaatatagtagaacttgtttatagaaccagggtaataggcatgatgggcaatacatattacctgaggaactgtaacctatttagcatacttaggatttgtccagttatccgcttaatacactcccccacactctggagtttctctttcccctcttatctcctgccctcttttatgcctacattctggtcacttctgaattaaccataatattttagaagcaaaaaaacgtgtctatagccaaataagtactgcattgctttccaaattgaaaccccaaattgttaaaactctggacttattaccacttttccccatgcaatatccatgtcatattaattgtttagaccctgattgactctaatagactcaaagaataataataatttattatttgaaaataaatttcaaataatagagtgtggacatgtaattaatatgcacaacaaatgctcttggaaattcacgcagaatattcccaactgcagtaccagctatcattgcagcgtgcccacagagggtcagcagcatcccaaaacacatgcccagtcacaaatgggcaaaatcacatccacatgtgtaaacacattggagaataagttggtatattcaagtgcaactgatgcatgggttcaacttctttgaccccagctttgtttcaagatgtcagtttctgccgctcagcaggaattccccagaaaagaacctgccgattggcatctacaaagcaggccccctctctgcactattttagatctttcttttctcatctttgcagatagagaacagcaggaagaataaatgattggattcaaatatgaaggaatgttctcttttagcagacctaatttcattatgtttcacagagatggactgatgaagtcaacacatttacaccgaaaatctctacgtctcaaatgcaaatgtcaacgtatgtcacaaacctttataatttgcattccttagaactacacttctagaaatcaatcctagggaaataccagaaaagtgcaaaaagacatatatcaagggtattaatcacagtagtgtttatacagcaggaagaaaaaaaaatctggaagcattctaaagtgaggcaggataggtcatcaaggaaggttcttggatgcagcaaccatggtgacccaagagtcaacacaatcacattgtaattgagctcgatcaggcaaagctatcttcagtacagactttctcctctagagagcatgtgcgctttgattttacctgtcctcaaattgacctttcgctcattataatagtaaattataaatctccctgggtggagatttaaggtgctaatgagacatgcgatgtatgaacaagaattgcagctactgagcatgtgcacccacaggaccacccagaacatgtttatagcaacacctcttcccacctacttatgaataattgtgtaagactcccctaaagggagtctccctagagcaagtctttgctgtctcgtccttatgagcagcctgccctgattctcttacggtgtactgtctattctgcacctaactttcaaaatactctttttcttttgcaataaattactgtatgctacatctcctttgctgtgcatctcttaaattcttttaaactaagaagacaagaaccaaggtatcacaacagtgctcaaccaaggaaatcagtagataaattatgggatagctccatagtggaaaacgattagagtcattaacatgaggctaaaagaatgtatttatgggcctggaaaatgtttattacttattttaagtaggaatttgtttcagtttcctatggctgctataataaattaccacaaatttagtggattttaaaaacccacaaatgtattattttgcagttctggaggtcaaaatttaaacgagtctctctcggctaaaatcaagatgtcagcaggatggtattccttctggaggctctcagggataatactttctccttgccttctcagcttctggaggctgcctgcaggccttgacccatggttgctttctccgtcttcaaagccaggagagcagcatcttccactctgtctctgactctgccctctgcttccactggcacatctgcttcttgactctgacctttctgtctaccgcttataaggaccctgtgattacacgggggccacatagataatctaggctaccctccccatctcaagccccttaatcacatctgcaaagttgctttagtcatttaaggtaacatagtcacaaattccagggattaacatatggacatctttggaggtctatgatcctgagtgccacaaaagttcaaattgcagaataatatacctaggtatggttctatttttctatgttttgacaaaaattatataaatattggccaacagacactcctatcactcaggacatgccaaggttttgaagacctgtgccaggaagtgaggacgaagactggatatattccttgttctactacattcagcttttaaaattcgcaaaccaggaggagacctgccctgcttttctcagctctttgctcttagcagccctttccttcagtaatgattgcaaaatgcacagatgtaccaaaagggaggaggggataatggaggaggagagacatatttggctaatatttactcacattatcttccactcatgcgtgcatgcatatatatatatatgccataaaccttgaagctcatatgagacctctccctggcacagtgactccatgctcatattttcacttatttttctattcaacaaataagtagtgagtccctacaatatagtgaactccaggaaaagctctggaatacagaaggcacagggcttgccccactgggagcttacaatttagcaggtgagagggacaccaaacagctagggaaacagataattactttatcacaatggtgctgtgagggaaaagtactgggtggtgtgagcacatgctgggagagtaacacttgacaacaggatcagaaaaggcagtcccaggcagctccagtcactgttgaggactgaagcaagcgtaggtgtcagcaagataaagctgggaaggtagagtggaaagaagagggtcccagcattagaaacatgcatgcgagctctggattgggaagcctttcttcaaggaaccaaataaggcatagcatggagcacagaggatgagagagaaggaggatgcagctgcaggggtaacctggggccaggaatcggggtccagtgggtgaaagtaaaggtattgggcttatgtaaaaagcaatggtgagccactgaggggtttaagcagagggtcaacatgatgaaatgtatgttttaaaaacctgactgcactgcagtgtcaacaataaacaggagggagctaaggaaatttggggaggaaacatcgattgctatttccacgatatgattctggatctgacccagatgatggtatgggggcggagagaagtggacaggtatttacgaagatgaactctgcctcagggacgatgcccaagtgtccagcttgagcaacctgatgttgctttgaaccaataaggagtggtgaaggatctaattagaggacaagggaagggaagtatgagggtacggcatgagtttagtttcacttatgtagtcccaattttgtctcctgtctttataaactctcaacatctctcagaaaatctgctattttggtaccaaaccacatttccaggcttctttcagtataaaagtattcccaaggttcttttttcttttttaatcagaccaagagcctttgggtacaaaaatacagccataaaatctgtgagatatccccttaggcttaagaagtgacgttaattaaccaagcttctacagcttatatctattgtaaattttagcacaatgattataataaacacaagtaagcttgttttcttttaggcaaaaaaacatttggaaacctcaacctggaaacgtaattctattctggcaaagaccagatccctctgaaatgattactaccattactacccgactctcttttctgtactcaaccttgattaaataatgggaaacacatggataaaatgagtcccctgcaaatgtcaggacaaaagaacttttacccctaggttcctccagcaatatggcaggtttccctactacacagtgattaattcagagatatggagttaatctacaacaaagttccaacagacacattttaatattgtttattgtaaccagaaatggatggcacatactgcaacggttactaaccaattttcataatcaaaaagaattatgctatattggccaaaatattagtcatgggattagaacccatcctcccttgaatagcctaatcctctttaaaatagctcagagtaatcaggttagcttcacagtaaattttagtaaacccatcacttttatgaaataatttcagaaaaggaaagatcaaagttttttaaatccttgatgctgatgaaacactgggcaaaataaatgtcttacaaagcacttatataattgatttaagctaactatcctaatagagatacatttgccattacaaatggatttgtattataaagtggaaactagcactagcactgtggaaacaagttctcagtgctggttttctgaaaaatgggacagtaacaagaaaaggcatagggaaatgtctcaccaagcaccctgccttccagccatttttaaatgaaagccctttctggcaatgctattttgtgtaaatgatgaccagatagggtggctgattgctttgtgacctctgtttaacacagcaccctctcctagtcaacactatgttggcacgcaaaaacagcccgagcttttcaaagcatccagtttgctctgggggagcagtcaccttaagacttctaagaattttatgcatgcgatattacttggccacaaccctatcttcctagactgcaaaagtgcttgagaaaacaagaatgggatcacaagtgtgctcctgtaagtttccacagagattcagttcctaattggatcttttcatgtcatcttggattcttattttattctaatttatccactgtcaatccagacctatcaaaaaaatcacaatgatcacatctatatatctttattcaagttactgataaaaacattaaaggttacagaccctagaacaatgacctttgacctattccaagtcagcatagaatggcctcatcacccaacttgttgttcttcccaataagtgtccttgcatccaaccctaagttttctaaaggcttatccgaaactgaatatacacaaaatcaacaatgtgggtctcatgaatgcatgccctcaaacaggttctgagattcaaaaccttccattgactaatgaagaaaatttcccctggttccaccccacctaaacatgggttcccattactgtctcttctttgccatctgcccacaagtcagccaccctgttgaaagtgaaaaagctactgccaacataatttcaatcaaaatgcttttatacttttggagagtattagtgtgatggttaattttatgtggaaacttgactgggccatggtgactacatattgttcaaacgttattctggatatttctgggaacatggtttttcaatgagatttacacttaaattgagactttgagtaaaacagaatgttctccatagtgtggctgtcttatccacattatggatgagattagatgacattgtgcctcatccaatcatttgaaggtctgaacagaacgaaagactgacttcccccaagcaagagttgtacatgcatatcctatgggctctgttcatctggacaagcctcactaatacaaaaatatataatactttttattacaaaaagtgcaagaatttcctaatacattgcacaaaaacaatcttgtacccatatttcttcaattagtcattttatcataatagcctctttattctctttaagtggttcacacccagagttctttagaactctttcaggatgcttccaccttcttgtttgtctttgaagtcttaagtaaaggaaatataaatatttcaccactgcaattcctgttttctactcttcagaagatctcccctgaatcatgggtcaaaatacagccactctttggtatagaagtcataagaatattaataactcatagtggacttatcagtcatgcttattaataaaaacattacattcaggacacaagagcccctttgaggcaaatgagaaagggaagcctagctgagactgacaggaactggagtggctaagggaaagaggaccctgtgcacaaacacttctatggaacatgaagaaaggcctcatcggttctaggcactgccagagacatccacttttttgtggctataataatgatattttcaatgacaaatgatttctcaggagaggtcttggtctaatgagatgctaccataaagtaataaaaccacaaaagactgtaaaaaaacagaatgatagataagctatggaacactgccaagttgtctttgcatttcaattacttgtggcaataagagacagacataatatgggtaataaaaagccaaccataatccaaaaacttaattttagcaaatggttcaaagtcttcccacaagatcctttactaaagcaattgacaaatgttgcatttgcaggagagagctacagaagcctgcctgagaagaccacttaaaagccagagtctcccagaggagcagtgctgggtgaagtatccagaggtctcaaagagactggctccatccgtcctcaacagacagatgtataaataagaatgctggttctaaatctcaacaaaagaattcttgactcagcaggacacttacttcttctgatcagcacattctctcccttttgaaaactccaacattgacaattataaacaaaaggttgtttgatgagcatgaagtgaggacaagggaagcttgtagaataatttgaaggatagtgataccaactcttggggaaacaaacctttcagagagaccaaaacctgtgcctactgctagacatcctctccatgagcagtgaagttcctacaccagaaatattctgctcgcaaaagtcttgatctctgagccccttgtttataatctgatctcttaacaacaaggtcttttctcagatgaggtggtttagaatagactaagtacaactttagacatgctaatacaccataatttcctgaaagccactgactctccttcctaatcactgacaacatgactatactctaaaactcccctaatacccatttatagatcaatgcatagggtgagtgttctgggctgaattgtgtctcccaaaatgcatatgttgaagtcctctcccctcagttcctcagtgtacgactgtatttgaagacagggtctttaacgaggtgattaagttaaaatgagatcattttaagtgaggtcctcatccattacaaatggtggccttataaaagggaaattcagacacagagacaggtacaaatagaaggaagaccatgagaaagcacggggaggagatggccatggacaagccacggacagaggcctagaacagagtcttccttcacagcctcagaaggaaccaaccctgctgacacctctgttactggtggaagagatctgagttaccctgagttactggtagtgaatctataaggatccacagcaacttcagtccttgcctcctcagaagaaagaattcatctgaggggcataaagcagaaaaagagaccgaggcaagtttcagagcaggagtgctagtttatttaaaaggctttaaaacaggaaagaaaggaaaattcatttgaaagagacccaagcgggcacctgaagatccaagagagaaaagagagcaaaagaagactgcaaaaagagagcctttcaccttgatcccaggactttttgggctcacctcttcccatgattcttccctttagggtgggctttccacatgcccagtgcttgcaccctttggcattgagcacagcgcagtgtgtttaaggagttatatgcatgcccacgtgagcctttcttcccttttctggtggagttgcccccagaagatcatacttcaccacttttgtctcttgacacgtatgtccaggaagttgcttctccctggggtttgcattcaattgacattttgatgttaatgggtgtggaccattagtaagtggcctctccctcgtgctgccaaactgtcatttttagaaaggcaatgcaataaccaccgaaccatcaccagacattctagtgggtggaggaagagccctctcctgccctgctcatgcctaactacctgtaactcctccatatcagacttccagcctccagaactgagagacaatgcatttctgttggttaactcacccaatctgtgttacttcgttaggacaaccctagaaagctaatacagtgggtggcttcagaacttatgtgtggattttttcctctcagagtttttcataattttaagaggtttgcattagtttgtttgtccctacctaccaccaccaccaaacaataaaagttactacccacagcatagctaacgagcagggagctccctattgccaaagatggagggagggaagctctctctgttaaaggagggagcagggatgcttgtagaccccaaattacataattagctcagagtaactggtaaaacataggttgataaagaatcatgcgtatatattcattcacactattgaatatccatgaaaccattgtcttcacttggaccctcaatattcacctacccctttattcccaatcccctgcaatctcttctttttctctttttttagtgataaatgctacatatttatgggagaaggctagagtattgtggtggtgatgggtgataacactttttttcattattatactttaagttctgggatacatgtgcacaacatgcagctttgttacataggtatacacgtgccctggtggtttgctgcacccatcaacccatcatctacattaggtatttctcctaatgctatccctcccctagtcccacaccccctgacaggccccgatgtgtgatgtccccctccctgtgttcatgtgttctcattgttcagctcccacttatgagtgagaacatgcagtgtttgattttctgttcttgtgttagtttgctgagaacgatggtttccaacttcatccatgtccctgcaaaggacatgaactcatccttttttatggctgcatagtattccatgctatatatgtgccacattttcttaatccagtctattgttggtgggcatttgggttggttgctattgtgaacagtgcagcaataaacatacgtgagcatgtatctttatagtagaatgatttataatcctttgggtgtatacccagtaatgggattgctgggaaaaatggtatttctagttctagatccttgagaaattgccacactgtcttccacaatggttgaactaatttacactcccaccaacagtgtaaaagtgttcctatttctctgcatcctctccagcatctgttgtttcctgactttttaatgatcgccattctaactggtgtgagatggtatctcattacggttttgatttgcctttctctaatgaccagtgatgatgagctttttttcatatgtttgttggctgcataaatgtcttcttttgagaagtgtctattcatattctttgccactttttgatagggttttttttttcttgtaaatttgtttgagttcattgtagattctggatattagccctttgtcagatgagtagattgcaaaaattttatcccactatgtaggctgcctgttcactcttgtgatagtttcttttgctgtgcagaagctctttagtttaattagatcccatctgtcaattttggcttttgttgccattgcttttggtgttttagtcatgaagtatttgcccatgcctatgtcctgaatggtattgcctaggttttcttctaaggtttttatggttttaggtcttatgtttaagtctttaatccatcttgagttaatttttgtacaaggtgtaagggaaagatccagtttcagctttctgcatatggctagccagttttcccaacaccatttattaaatacggaatcctttccccattgcttgtttttgtcaggtttgtcaaagttcaagggatgctttttatggctctttaactgccaaatccagtggatgattttttgctatctttctggacctcttctacatgggatcccttcctccctgttgaaatgcgccatctttattcattcacatcacaatgaatcaagtctcttccatgatctctgccaatgatattattcctccaggtgccctggtaaatatcactgtctcttgaatttgtgctagcccacttctatcaatacataaatgtatttgccacttacacactgatggccctcataccaacatcaagaacctgaaaccgactttgcaaaaattataaccatgagaaaaattatggcagtgggggagatctgatctagctaaccctcatcttgcctttagccttcaagatgcccttaataattccaaggcttaaaccaaactaacctggggggacttttagtttatagtttaaatgataatagcccttccccaaaacttaaccacctgtgtaaagttaatgagagaccactgggctaggaggatacaggggcctgaattctgccaaggcatagatataaatgattgctagccattattccagaggtcacaagataggcaacttccccaattactcttgcatataacgtcactattgtagaacttaaggttggccttttgagatatcttttcaggttttttgcatgtctgatgaccaatggctccacctagacatgccaattgctcctttggccccacccagaagcaactcagggcacaggaggaccattggccacacccctatgattgtaccccaaccaatcagtagcaagcacccatcatgtaggcactccaaccccttcctcaaaggggacctttttaaaaccctagtccacaaattctcaatgagattaagtaacaactctgtctcccatttggcatggttggcctcgcatcaatgaaactctttctttaccacaatgtcatggtctcatgtgttattagtccattttcacaccactgtaaagaactgcctgagactgggtcatttataaaggaaagaggtttaattgactcacagttgtgcatggctgtggagacctcacaaaacttacaattatggtggaaggcacaggggaagtaggcaccttctttataaggtgtcaggagagagaagagagtgagcaagagcagggaaaactggcttataaaatcatcagctttcatgagaactcactcactatcacaagaacagcatgagggacgatgcccccataatccaattacctcctttcctccctcaacacatggggattacaattcgagatgagatttgggtggaggcagagaactaaatcatatcactgtgaattgatcttgtttgtgcagtaggcaggaagaacacaatgggtggttacaaacccagccatttcccattgcacccagcctagtacagcttgtccagctttctaataaggaaactcgatgccaattccactcatatttctttagaaccatgtccacggctcttcctggaacccctcctcagtggcatcctcatgctctggaagaggacacacatattttattggccctctctgctttccctgcttataagtatctgaggatttgccctgcctgtagaataggtggaaaacattttaacatgccatgccagaccctccacaaattggttcagtttatctttcagcctccactccattctctctccaatcttccaagctattcacagcagacaacttgtttcttctcagacatttccaggcctttgttcatattcttcatgtctggagaatctttctctcctaatctgacctaaaaagagctacttgtcttcctaagattgaaaaagcactccttctctttagctttcaatgaatcatactcaggcagaattctaccatattccatgttccctctgtatgttacaaacgccactattgcagtgtttatatactgtgtcatggtcatttgcttatgaatctgccttctccatcactgcatgagccactgcaggaagtggccactgctctctcaactccaaagtctcttaagccccctaccatcatcaacatggtgactcagtgctcctgaagggaattcagctcttcagaggagggagtatgcacggcccacataagactaagagaaagaaatggctttgcaaagaaataaaaaatgatattcaccagagaatcagcacaccacttacccttttcaggatttatgactttctgaatataaaaacgtctaggatatatcatggagaatggcaccatccaaggctgggacctggtctctgaaattcctgacaggcagttctgctaactacaacttcaaatgaccccttcttcaatttagctatgtggaagtaaaaactgacctttcatctgcctgacaaggttgatgtcaagatcaacacaccttgtgaaatttagctcttgatattagtgtgagaagtcgccctaagacttctggagcagcagaatggtctcaaaaaggggagtcttggggatggctcatttgtttgagggagtctctgaacacatccttttggttcctatgatgtaaactaatgcctgcccattgttctagcggaaaactatgagactccctgatgcaaattcaggttatatgattagtctgaactgtgtctttgtcgactctttataggagggtgtggaagaggaggagcagaaataaatgactcctgatttagtgcaattttagaaagaactattgcctattgaagataaatgtcagtgtttcacagtaactcactagatcccccaacttgagacctggaatatcaagaaagatgccaagacatggatcaccctctaacgctggagtttgggctacagaaggaaataagcttggcctgggaaaacaaaaactgcactgggtggttcacatgtgcgctggtgtgatgggtgtggactagtcctggcccttagagcacatcctgatgttgaactagcctcttctgatgtggtcaccctgagagcccctggggtgagaggtgagcactttcccctgaaatgagtgtgtctttatgaaatccatacccctgggaagagggagataggggaacatggaatgcagactccagaggtaaaccctgaaattggacagtggggagccactgtcttctctctgatcttgtaagcggttggatttcaaatggtgagggattactgccagatctcataactgacctcacaacagttgaaaactattctcggaattgtacttcccttttgtcatccatagacctttggtagaaattttaccaatgctgagcctgactttagtcatgcaatgcgctctcagtggaaagccctgtgtgatttcggggatagagcggcaaagggggtcagtaatgttcctcccacgtggcccaagtagtggcccttcagccttccccaaaagagagagactggatccaccatagacgatgccacatgagggaagcagggaatgtggggggtgccaggaggatgatgctggatccaaagatgtgagggagtgaagcacacagagctcaaatccccagaaatccctcaaatacccaaggatccactggaggggaacaggcacctgcagggggacatttgaagtcatgtcactttgcaaattcaagaaaatataatttctatttgtacctgcaagctgatgagggctggacaccccagttaccatttcaaaccacttattttccatgcagatgcttggttgcacttttccactcacctaaggtgcactccagcaaccaggacgtagaggaacatactcatcccgtctgagccccacatctcctggctgtgaaatccatggcttcttctcaggaggagaatctggggagcatagcacattgcaaacaagtgcccattgtaggaacagtaacttttctgtcggctctccctcaccttgcccatttatgaatctgaagtaagaaacgtgtgggggtgtgtgtgtttacagtttatattggaaggtattgtaggataaaatgttcggttggagagctataacctttttcggcagtttcatataaccaatgaaaagttactcatgtaacattttaaagctttcaatttaattgacaaaaattaatgaacaagtagaagagcagcataaacacttggaattattagcgagaacataccatgcctatgaatttgtgcaggaagaccagctcccatgggataactccttaaagttgaagactggaattttagcccagaattacttctggaaggccaatcccaaaagtcactgactaattgggctaactggaaaagaaaaattgcacaaaatgtcccttcaatatatacattaatttgcttttattttattttcaactaaggcttttgtatctaattgtattgatttgtacttccaacaaatgaaaaatcctgacggagaaaacatttatagagggcaattctaaatgaaaatagagataaagaagaaggaaaagaaggtcacatgtgctataaaatctaaaatattattctttgacaacctgttttaagatactacaatcacttaaaactcagtaaaaaataccatcttgaacactctcaggaactgagaattgcatgtcccaaataattgtcaacatgacatagagcttttgttttatgggaaggcagttcccaactgacaaatgggttgtactcaaaaagttctcttgaagttaattgttcagaacttggaccagctcacaaaagaaagttaaccctaagtgctccttggcctagtttgctagggctgtcctcacagaataccacagactagggctgcaacaacagaaatgtactgtctcacagctctggaggccagaagtttgagatcaaggtctcagtggaactggttcctattgagggctgtgaggaaaaattccgccttatgcctctctcccttcttctggtggttttctggtagtctttggcatttgatccctgtcttcatctttacttggtgttctccctgggcttatgtctgtctcagtgttcaaatttccattttttcagagggacacagtcacactgcactaggagctcaccctactccagtattacctaatttaaacttaactaattacatctgcaacaatcttgtcttcaaataaagtcacagcttggatactggaggtaaggacttcaatatgtgatctctggggagggagaacacaaatcaactactagcgtgcctaaacgttttgctaatacactccttcagcagcatcactgagaacttctctcagccattctgagccagatggctctcagagctcatagggcttctgcacttggaatgtggataagaggagggcaggaccgagtctttggagcccatgaattgtgaactccatatctgcataagccagggcagagcactgaaccacagtgctgcagaccagagttcaagtcccccggcaaagccatctgcctcctacagcaaaggttccaagatttgggatgcatcagggtcacctggagggtacgttgaaatgcaggtgacaggtccacagcccctgttcctgacttggcacatctggaatggggcccaggaatttgcatttctagtaagttcccaggtgaggctgatgcagctggtgctggagcacacttcaagaaccatgtcctaaaggatgcatgaatgaaaagatttggtttctgattaaaagaaaatacttacaaaggagataaaatctgtcttcccaggaaacacgtttgaaggaagaggaggcataataggttgaatagtggtttccccaaaacacaaaataggaacctgtaaatctgacttgatttggaaaaatgtttcacagatgtatttaagttaaggatgttgaggtgagatcatcctggattaaccatgtgggccctaaatccaataccttatgtcctccttgtcaaagccagacgaggagaatacactgaccctgagaaggccaagtgaaggcagagattggagagatgcaaccacaggccaagcaatgccaggagtcaccagaagctggaagtggaaagaaggatcaccccttaattgccctagagggactgtggctcagccagcaccttaatttttgactctggcctctcagacaataggaaaattaatttctattgttttaagccactcaggttgtggtactttgccacagcagccctaagaaattaatgcaagggaaaaactattcaaggagacaaaggaggtcaccatataatgataaaagggtcaattcagcaaaaaaaaagaacaattttaaacatatgtgcacctaacatgggagcacccagatacataaagaaaatattattagagctaaagagagataggtccaaatacaaaaatagctgaattcaacaccccactttcagcataggacagctcttccagacagacagaaaatcaacaaagaatcatcagacttaatctgcaaatggatctataacatagatccattattaccctgacaccaaaacagacaaagacacatcaaaaaaaaaaaaaagaaagaaaagaaaattacaggccgatatctctgatgaaatactgatgcaaacatcctcaacagaatgttagcaaatagattacagaccaaatgaatctattaataatagatatttatagaatatttcatctgagaattgaggaatacacattctttttctcagcacatggatcattctcaaggatagatcatttgtttggtcacaaaataagtctcaaaacattaaaacaaattgaaataatatgaaattaaacaatttgctccccaatgaccagtgggtcaatgaagaaatattcttagtttttctttttgaaaaatttcttaaaataaattataatggaaacataacaaacaagaacctatgggataaagcaaaagcagtactcagagggaagcatataggtataagcacctacatcaaaaaaagaggaaaaacttcaaataaataacctaatgatgcatcttaaaaactagaaaaacaagagcaaaccaaacccaaaattagaagaaatcacaaagatcagagcagaaataaatgaaattgaaattaaaaaatacaaaagaccaattaaacagttgttttttttttgaaaagttaaacaaaattgacaaacctttaactagactaagaaaaaaagagagaagacaaaaataaagtcagaaatgaaaaaggagacattacaacagatattgcagagtggctactatgagcaactatatgccaataatttggaaaatctagaagaaatgcacaaattcctagatatatacaacctattaagattgagccaggaagaaatccaaaacctgaacagaccaataacaagtgaggagatctaagtcatagtaaaaagtcttccagtaaagaaaagcccagaaactgatggcctcactgatgaattctacaaaacattaaaaagaactaatactaatcttactcaaactattccaaaaaacagagaagaaactcatttctcctcattctatgaggccagtattattaccctgataccaaaaccaaagacacatcaaaaaaaaaaaaaaaaagaaaactgcaggccaatatctctgatgaatattgatggaaacatcctcaacggaatgctagcaaaccaaattcaacaatgcattagaaagatcattcatcatgaccaagtggaatttatccctgggatacaaggatggttcaacatatgcaaatcaatcaacatgatacatcatatcaaaaacattaaagataaaaaccatatgaccatttcaattgatgctgaaaaagcatttgataaaatttggtgtccgttatgattagaaaaaccctcaaaaaactggaaaaagacagaacatacctcaacataatagaaggcatatacaacagacccatggctaatatcatactgaatggggaaaaactgaaagcctttcctctaagatctggaacgcaataagaatgcccagttacaccactgttattcaacatagtactggaagtcctagctagaacactcagacaagagaaagatatagggcatccaaagaaagatataaagggcatccaaactggaaaggaggaagtcaaattacccttgtttgctgatgatatgatcctatatttgaaataacctaaagactccacatgaaaactagaactgatagcaaactcaataaagttgcaggatacaaaatcagcatacaaaaatcagcagcatttctatttgccaacagtgaacaatctgaaaaagaaacaaaacaaataatcccatttacaatagctacacataaaattaaatatctagcaattaaccaaagaagtgaaagatatctacaatgaaaactataaaacacttctgaaggaaactgaagaggacaccaaaataaaggaaaatattctgtgtacatgaattaaaagaacaatattgttaaaatgtccatactacccaaagctatctacagattcaacgcaatccctatcaaaataccaatggcattctaaacagaaatagaaaacacaatcccaaaatttatggaaccacagaagacccagaatagccaaagctattctaagcaaaaaagaataaaactggaagaatcacattacctaatttcaaattatgctacagagctacagtaatcaaaacagcatggtactggcataacaatatacatataaatcaatggaatcaaatagaaacccagaaacaaatccacgcacctacaattagtccattttttacaaaagtaacaagaatatccactggggaaatgacagtcttttcaataagtggtgcttggaaaactggatatccatatacaaaagaaggagactagacccctatctttcaccatatacaaaaaaaagcaaatcaaaatggattgaagacttaaatctaagacctcaactatgaaactattacaagaaaacattgaggaaaatctcccagacattggtctgggcaaaaatatcttaagcaataccctacaagcacaggcagccaaagcagacatggacaaatggtatcatatcaattcaaggatacaatcaacaaagtgaagagacagtgcacagaatgggagaaaatatttgccaactacccctctgacaagggtaataaccaaaatatataaacagcccaaacaactctataggaaaaaatttaatagtctgatcaaaagatgagtgaaaaatttgaatagacatttttcaaaagaagacatgcaaatggcaaacaggcatatgaaaagatgctcaatatcattgatcagagaaatgcaaatcaaaactacaatgagatatcatttcaccccagttaaaatggcttatatccaaaagacacgtaataacaaatgctggcaaggatgtagggaaaagggaactctcatattctgttgatgggaatgtaaattagtacaaccactatggagaacagtatggaggttcttccaaaaactaaaaattgagctaccatatgatccagcaatctcactgctgggtatgtacccaaaagaaaggaaatcagtacatcaaagagatatctgcactcctatgtttattgcagcactgttcacaacagctaagatttggaagcaacataagtgtccatcagcaggtgaataaagaaaatgtgttacatatacacctgagccagggaaagaacttcccttcccccatagggacttggctgaagtcatcaaaaaggagacagtgttcgatggagttagcaatcccttgggaagcttcatcactgggaagatgagagcccaggtgagctggcagccatctttgctaccccgtggagtgcctacctgcaaaggaggcaactccgcatgcacccccaggacccaggctcacctcaggcaccccgggctttgctgaaacaggaggcatacattaaataaatttgagttgagtttctgtcacttgtagccaaaaatatcctaatacagacactgagagggaaggaaagagcataacctatgttgaggcaaactttatgttttatttttaaaaaataaaggatgataccctttagtgcttgggttggtagctaactttgaatgtgtgtgataagacattttttttcttttgtgtgtgtgtgtgtgtgtgtgtgtgtgtgtgtgtgtttggttttggtttacttcagagtgttctaggcatgttgagatacactaggacaagaaacaatgggcacaaattctcttaaaaggcatttctttaaccaaagcgtaagaaggtagaagttcccaaccatggcattggtttagtttcctgcctagatgtttctgtccacacaatggccctcatcacctgaaggcccaaaatccgtggagtcatgcagctgttaggtcaccagcagaatgtgacctgctcaggacggccttgcggcagaaaagccagtcctgacacatgaaccgtggctcctgggttatctgggggctggtatctcacaacactgctattaatcagttcattgccacattttcctctggggcatacataatttatgtatggcaactcttcctggaatttcattttaaaaacagaacaactcattccctttcgttttaagaaagtttttggtttgtgttgttagaagcaggctgaaataaacgaaggggactcaaatgtgagaggtcaattcaacaaatgtgcactcggtgtctctttcaagaaaaatgttatgctggggtagtgtggaagggtggaggggtggaggggacagagaaaactgtacccttccccaaagagcttacagtctagctggacagagaggacaaagataaagccaggggaatatgacaaacacacacatctcaaaaaagttcagcaaaaaaagacaaaaattttcatgaacctttagagaaggggtgtattcgggttcttcagaggacagaaccaatataatagatatagatatagagaaagaaatgtcttatgggaatcagctcacgtgattctggaggctgaggagccccacaatctgccatctgcaagctggaggccccagaaagccagtagagtaattcagtccaaagcctgaaggcctgagaaccaggagagaccacggcataagttccagcatgagtcagaaggccccagaaccaggagcactgatgtatgagagcgggagatgcacggcccagcccaaacagagcaaatgtgcccttccttctttttgctctattcagtccctcaatggtgacagcagatcttctgagctcagtctacctacttaaatgctaagctcttctggaaaccccctcacagacacacccagaaataatgcatccattaggtcaaattgacacataaaattaaccatcataagggattacacattcaactaaaattccagatgtatttaaaatttgacatgggccataaatagtagagggtggatatcttcaaatttccattttaaaaaaggattatactactcagtcataaaaagggatgaattaatggcatttgcagtgacctagatgagattggagactattattctaagtaaaataactcaggaatgaaaaactaaacatcatatgttctcactcataagtgggagctaagctatgaagatgcaaaggcataagaataacacagtggactttggggactcagggggaaagagtgggaaggggtgagggataaaagaccacaaatagggtgcagtgtataccgcccaggtgatgggtgcaccaaaatctcacaaatcaccacaaaagaagttactcatgtaaccgaacaccacctgttccccaactatggaaatacaatttttttaaaggattgtctatatcctttatatgctcacaatgatcattaatacacactttcagactcgtggtttttgaaaagttattgtcaagataacccattctaattgtgaatgaagagaagagaaaagtgggtagaatggaaaggagaaactggaaacgatcaaatgggagaggacaaaattattagctccctggactgggtagattttgagaactggagtaagacgaacatcggcgcgatccatgaggtttttagcactgtgatgacctcagtagcatctccacccatggatacgcctcaaacccagtctgtgtccttgggcctcacccaatgctcagtggcagcctccagaaagcatcatagctctacttaaatggaaaagaaacaattaaactatcacctcctaatgaatgcatggaggtctacttctcaggagttacgatttcccaggcctggaacaaaatttcagctcaggtaaatattaagaagatgaagttttaccatgagcacctgtagggcagagtctctccccagctttcataacacgcagcagtgtttgcatactgcatttaataacagctgttattataagaatcaagatttggcagagtctctataattttcaatagagtctctgtaattaaataatctgatgttttgcccaatcctcctcacttttatcccatttaaagtgggcatacgctgttttttccacatgcttcttttttctgttctcaatctttcatctttctgggtggcttcagatcccatgtttgagcctcattcttctcctctccaattaaacttcattcccggctctttatggaattcatagagaataactaaaacatctgacagatgcaagttaacattttctgggcaattttaattgacaatcagatggaactaatacctgatcaaccaattgacgtgataaaccagaaaaaagcaagaacacagaccgaaggccatgccaggaagaaacccaaaactactgacaaaacagataacaaattttttaacattttaatcattatcaactttggcatatgaataaatgtttgacatcttaccagttgtaatcctaccttgaactgccataagatgttatcagaaacatatgagaggaaattaggaggaaaagcctaaatcaaaaaatatcatcatttttatggcatttgtgctggaattatttctagaataatgcagtttcacagctataattcaaactatgttttagtctattggtttaactgcagcatatctgaagttaagaagtttttatagtgctcagtcccacagaatgatggttaaaaaccttagaaaaaatgcaattataatagacggcagttttgtcctttcttttttcttaaaaatggacttcatttgcagacctgctaaaccaatagctgctttctaactcccaactgtgttagtctgttctcatgttgccatgaagaaatacccaagactgagtataatggaaaaaggtttaattgattcacagttccacatggctggggaggcctcaggaaacttacagtcatggcagaaggcacctcttcacagggtggcaggagagagaatgagtgcccaacaaagagggaaactcctaaaaacatcataagatcttatgagaactaattcactatcgtgagaactaattcactatcacaagaacaggataggagaaaccacccccatgattcaattatctccacctggtccctccctcgacaccatggggatcggaacgataattcaagatgagatttgggtaagggaacagccaaaccatatcaccaatccagtgtctataacaatggcttggattactaatccagaaaagctacagagggacacataggttattaaatatagtatgagaatgtttttaaaaaataattatttaatactcttattcaggtaaaatagaatctgatcctaatgcagttttaaatatatcacatgataaaataattacacagatttctacaaatacatgtggcatcaataagaatccagaaaaggcccaatcatgctgagggctggaggtctcatcttttatcttaaggcaacgaagaagcagaactgaaagattccctaggcttgtgggatgctggtgttctggctgccaaggacagcttcatgcatgcccagtagctgtgctgatggcccctgctgtcctataggaggtgatgagagcaactggccgcagaggtggctcggcacctcttgttttcctttccacatccgcctcttaattagggccattttaaaaagctatttggaaatgggccgagcaggaagtgagtatcaggtagagttttgaggaaaggatttcagaattatttagagttcattcttagagattatttaatccaaatatctctgtttgatccaaggacatgaagtccaagaaattaagtagctcacccaaaaccaagtagctaattcatggcagagccattagaacccagcctctaggtcactgtctccagcagcttcccctacatcagggctcagacacactcttctcttctaagataaacatcctctgatcagaaccttctctcctccaggctgtgaaggtcttgggctggctgaagcaccaggccaacatgtctgaagggtgacaatgggctctcaggctgagtttgtactcaaatgaagagtagatctttattggtaggactcagctgagaagtaagttcaagtgagtcacatttattaatgtctatcttagagcctccatgtgcagtgctttattagtatacatgcattatgcagcatgagttgtttgcaatctggggcacagagaagaaccaatggctccagcagcctggcagtagtttcagtctttgtaagctcccacaccctgcagcaaagacctgcagcctttaactatggtctagtccttcctacaatgagatagtattaaatagattatgtcaaaatcaaatatttaagaaaggatacagcaaatatgaaatatacagtagatttatctcattaacaaagccaactttctcccttggagttacaattgtggggggcaggatttgcgcatttaagcaaagtagcatcatgccaagagctgtaatttatttcaaaactatgaagactccattactcttggtgaattttagaaatttcctttaaggggatcatttgtttgctattatactgcatgacaccttttgtgtgtgtgtgtgtgtgtgtgtgtgtgtgtgtgtatttagtcttatagtttctcatcctattttttagtatattttcatatgtattaaaagagatttgcaaagtgagtcaaatccatttttattttttaggacgtttttcagaattaaatatgtattcttaatgaattttttaaacatacacatacatataactagatactgtattaataatttaaagggaagagtaattataagagaagtttatttggattccattaaaatcatgtgtgtgagatgtgctatatcccaccaactcttcatacaagaatgctatggaataaagtagtagggaaagcctacctgtggtccagtgagatttctactggatttctcacaatcttagaatagtgctagcattcttgcaaattttgagagtggccaggtttatcaaggatggtcctcgctgccaccagaagcaggtccagttgatattccagttgctgtcactcacagctacagaacttgtaccatgctttctttaattccagacagcattctttctccttggtcaggcagttttgcctgtgttgggtcagtgaaccagtgaaccatgggtcacatggttctgatgagggcagatgagctttctagtcccttggttctgcatgtcaaccctcctcttttcatatccatggttagcattgactcctagttactgggatcaggaagcagagaagtttattaaattgctgatgctacaaaacgtatgggaatctggcaattttagatacccaataactagcccattaggctagtcatcctagagtacagagttccataaagacggtattaggcaccagactttgtcttttgtttttgactcctaatcggagaaggctaaaactttgctgctggatgcagtatacaataaactggttaatgacttaagctactcagctttattaagaatctactaggtgctttaccttttctggaagtctgacataaaatggttaagaacaatacacaccattgtgaaaacagcactgatgtctgctaaatatttaatttatgactgagatattctggataaaatccgttcccttcatgatgaaagcccatctgtgccctcaggagcattttctagtaaaaacactttctcattcttaagtgcctgcagcctgcccatccccctctttcgtcttccctgccagaggttttaggagaagaggaccacttctacacccttgataaaaacaattctgagaattagttaactgagacaggttgtaatttcctaccatggctaagttgctaagtaaatattgcaaagcaaacagaaaagatagaagcattcatttctcttccaacaaagaaaaacaaaaaggtagtttcttggatatgagaaacaaagggaaaaggggaaatcatcctatgtttgcttttttaaaataggctttgagtctcatatgcctttttttattattttgttccagttttattttggttttgcttcaggtaaaaaaaaaattggaggcctgatattacgctaagtgaaatattacataatctcacttttgtgtggaatacttctttaaaaggtcaaatatagacagaatggtaccagtagttaccagaattgggactagctggggtgggtggcatgagaaatgcggaaatataggtcaaaggatgcaaagtggcaaatatgtaccataaacaagtccaaagatctaactacaacatgagggctatagttaataatagtatatcatattcagcatgtttgctaatgtgtatattacagctgctcttacggtggggtatgggtaactatttgggatgagggatttgttaatttgttccactatagtaacattttaccatttctatgtatttcataatatcatattgtataccttaaatatatacaataaaatttatttataaagaaaaagaaaagttacagagcacactaagtccctgtttttccctgatagctcttgagggaagagatggaggtttgcattgaagtgggaaggaagccaggatgacttgatcctaatgcaaagttagagtgaaaaactcacccaggcttcacacaaaaccagcacagagaagtagtcaggtttctctccaaatgaaagtaaaatgtaaaagagctcccacatgttattgagctcatacatgtgctatgaaagatacagagaagtaagaaatctgaacctaccttcaagtcatttaaactctactgtggtacatacataagtcattccctacaggaaagctaggtaatggcaaaggtggaacacacaaagtatgcaatgagtggttcttaaagcaagtagcatgggatgattttcctctctcatgtccttggctccaagcatcatcatcaagatgagctttcctatattggtatacccgtttttgacctctccattgaactccttatctatgtgttcaacttcttgattgacatctccacttgggtatcaacaggattctcaaatgttttccctagatttacttctccactagtcttctccatctcagcaatgattcttcccctgactcagcttctcaagtgaaaagcctggcaatcatctttaatgtcttggttaacctgacatgacacatccaattaatccttaagtcttactggctctacctccccagcttaacctgaattcacccatgtcctgccatggccaccaccaccgccatctctggcctccactactgcaatgaccttcttccttcactcctctccctctatggtctgttctccataatttaggcagcagtcatttccccaaccaccacagggcctttgcaggagtgcttcccagccaagaatgtacttctctaagagccattctcatccttctgctaccagctcagatgttctctactccccacccatccagatcagctaatcggaaggaacagtgggtcactctctgttgctccatccaatcttacctcagaactttattacaatctgctatgttattatttaataatttacacgttgactgcctgtcttcccatttaggatgtgcattccagagagcagagaccgaatcctactggcttgtcactatggattgagtacctggaataaagcctggaatatagtaggcacttaataaatgttggttaaataagtaactagatgaatgattgttcctctctacactgaaatcaaccaacacgtcaacataaaaaaaaatggaagcacccacagatttttgtaggaaggccctccttgcctttacacattcacgtccaactcactgctccctggtcccaggctccctctctcagtatgatcctgctcctgcccttggatcctgcttaggccccaccacctcctgcctctccacttattctcaagttcctggggaacactcccacagggaagctcaagaggtatcctgcagcaggtgagctgctctggagcccaaaaccacccacaggcctggtgcatcacctggagggctcccctgacctccattcaagggtttcagacagggtcagaagataccatcacatattaagaagaaaggaggcttcctagagaagcctaatggtaactgggccttgcaagctggtgaatacaatgacctcccttaacgtatattaatgtttctcaaccttgttttcatcatcgcccctccccagcatggagccttttcagtcttttcacccccttcccacaaaatctgaatggcacagatatgctatatatctgtttacatactacagcctttcagagagccacaagccattataatatctaatattttttccacccctttcccccaaaaatcaattttcccttttaggggtaaatattgcctctgttgaaaatgcaggtcatatgtgtgtttctcttgtgtgaacagtgatgtctttctgttatcctatggatggtaggcaaatttccccttcaagaaaaatattttccagtattggttatttgagaatgtttggatccctttaggggaaaaaaatttgaacccctaaaagagggcatccagttggcagaagaagaaacacttcatccctcccatgactttgctctttatctccagactttaaggaatccagatgtctttgaagggtgagaggtggcccctgaatcacagggaaagctgggcattgggaatgcccggctttcccagagcagacattacctaaaaatgagaaactgtgtttggtgggctagacattatttcatgttattctgttcgctatctctatgaattcacgagtcagcaagggtaggaaagagaggtgaggaagacagaagagcgagcatgcagtgcgccctccatgggatcactgaggacagctgactccttcttctgagggaagggcagcatcacaaaggggatagaaatggaattcggcctgtgtctcaattttgtaggtctggcacctgcttacagccttgattttaactgaaccaatctagctgtccttccttcactcactcctttcaataaatattgagggtcaagtatttgtgagtactaggaaatgcaaggtcaggaagatgaactttgtttcccaaagagcctgctgcaaacagggaaagcacataggtgattatattaggagaacctgtgagtagaagcacaaagttcccccagagcatttgcaccagccctccatattgtcactcaccaagagacaggcagtgtttcttatttcaagaatgaaagcatcttttgggaacttttttgtacttccacgtttgtacttccaaattcattgtttttgaggaacataatcaagtagcataatgtcaagctgctgcctaaattaagatctcttccttcatttcactctcaccacaaaatcagtgattacaatcaaataaacaattacctttgtctggtaaaatctgcttttaattaacctatgtttgttcctcactgaaaatgcctccatgaagagtgcacctagtgagtccttctgctccagtaccttgaagaacagacaggcaataagcaaatggcctaatggccccatagctcctccattctcaagaccataaatctcaaaaaaatcaggtctgcacatgcagaaccagaaaccggagcttgccataggctgcttttgaggacacagagttgtctggagaatgggagaaagggaagactggctgtgaaggatggaagaggctctataagaagaatcaagactttaatctgcctggttataaaggtattatgtcagcttcataaggtgttataatgacatttttcctaatctcttgacattttcacatcattagaaacaataaatctcttcctgatgagtcacacattgtccaaaagccatggtcactttgaagtttcaaccaaaagaggaaattttatcaacaatacaaacagcccagacttgagcagacatttatccaaagaaaatatacaaatggccaaaagcacatgaaaagattctcaacatcaataatcattagaaagagcaaatcaaaaccacaatgaaataacacctcaccgcccatcaggatagttgtaatcaaaaatacagaaaataacaaatgttggtgaggacgtggagaaatcggagcccttgtgtgctgttggtaggaatctaaaatgatttggccactatggaaaatagtatgatggtttttcaaaatgctaaaaatagaactaccatatgatcccacaattccacttctaagtatttaaccaaaacaattgaaagcagagtcttgaagagagatttgcacatccatgtctgtagcagcactattcacaatagtcaaaagggagaagcaacccaagcgtccattgacagatgaataaataaacaaaatgtgtcacaaacacacaatggaatattattcagacttaaaaaagacaaggccaggcacagtggctcatgcctataatcccagcactttgggaggccaaggtgggtggatcacctgaggtcaggagttcaagaccagcctggtcaacatggcgaaactctactaaaaatacaaaaattagctgggcctggtggcgggcacctgtaatcccagctacttgggaggctgaggcaggataatcactggaacccaggaggtagaggttgcagtgagctgagattgtgccattgcactccagcaagagtgaaactccgtcagaaggaggatgaggagaaagaggaggaggatgaggaggaggaggagaagaagaaggagaagaaggagaaaatttggacatgtactacaatatggatgaacttggaagacattatggccaagtgaaataagctagtcacaaaaaggcaagtactgtgagattccacttctgtgaggtactacagaactggacacttaaaaatgattaagatgttaaattttatgttatgtgtatttttaccacaatttttttaaatcaacaaaccaaagaataaaaatataaaaagagaaaatatgctggcattaactattaaataccacatgtttagctaccaaggattcttttgctccatgcatccccaacccagcttcttctccccttcatgccatcatggcctggctgttatgtggggcaataagaagatatggagatggagatagaaatggagagagacagtgagacagagacacacagagagagaaatatctgtatccctctcttctatgtgaataataggacttgaatgggattaaatacttatccaaaggagcctgagacttttaccaaccagattaatatgaaaatcactagacttggttaacttaccataagtgactgacattttatgagcaggcaacatcttgattcccctcaccccatgtctggagaaaaagattcaaagaagcaagttgatggcagttttagaaaacagcaaagtactcccatatttgtattttactgaatgaagactactcaactatgagtctaggtttatgccccggcatacgaatgatctttgggatttagtctgcaattaggaaaagctgctggcacttggtggtaatagttggtcacattcatgtgtgctaaagagatggcagactctatagcaggagttttcaaccaggaatgacttcaccccctaggagatgtctgacagtatacagagacatttctagttgtcacaggttggaggttgctactggcatctggtgagtgagccagtgatactgctaaacctcctacaacacataggacagctgcctacaacagaaaatgatctgagccaaaatgtcagtagtgctggggtagagaaactctgctgcagatgagattcaccagaaacggggacaactgcagtttcccgctttggttcctgtattaaaatagctaagtgaatatgaaaaataaaatggtcacataaatcagctacatagagaagtctggtcctctgctagggaggttgaggggcagcagcttctctatcaagtccacccctactgcggccagctttcccagccagactcagccaagcatctgccatgcagcagcaggctaaccttgcttgttctattttggagttgcagaggccaacagagcagctagcctgctgaatgattcctcaatgaacctgattctgaaagcccttttctcaccctacctgagcttccctgctgggcactcctacacagtcaactcctccctccaggaagcaagatcctcccagagttcaacagcttgtcctaaagcttacatttatggctgcctcttgcaagcctagggctgaatctaaatggccattaagaaggcataatcctctcctgcagaattcctataagaattatcagcagaatagcagaagtgtgtagggcagggacacatttagctgcaagcatatttcaatattatggtctcaggtttgagagctctgtttatactgtgtaaacaactttctgggtacaaattaatattctgaagattaacaattaactgtcctttatcctgaattgatctaatactcgagatcaaattgatcaccaagcttgaagagaacatgacttttgaatattctgaattcctgcttgcacctaccaatcgtttctgtaataattttatgtctatcacaacataggatcagcagaagccagtaagtaggacctagattcctgagaggctggggattaatgcaaagacctgtgaccttgtatctgcatatgttctgtattttttttttcaattttgtgggagttttcactaaatttcttggtattcagaaaggatccttgaagatattaggaatcattgctttagagtatatgcaattacttcagtggaaatgtgatttcaaatttattctcagcaaatttgaagaaacaacagcccactcagctcctctgtacccagactgtagaatctgatctacagcagggtttccctaccccagcactaccgacactttggctcggatcagcttccaagttttagaagaagttgggaacgtgggaactactctatgtcttctaagtgtttctggcaatctgctctccatcttctggccactctatgctttctccactgtaatcacaagccagcccttcccatggtaaacaagaccactcattaaaagaatattatttattcgcccctttagcatagcactagagttccatcagacctctacattccaccagttcaaagaagaaaaaatatgtatctccatgtaaatgcatcaccccacaaaaaaaaaaataagatttaggttgactatttctctccaacaaatttccccatcattttctatcttctgaagatgggcaaaaagttgttattgaatttcttcccttgttttatttaatttgaactcgaatttaaatgcagtggttccccaagaaactgttacagcctgaggttttcatagccagtttcgagctacaaactcaagcttatctacaaatgtacatttttaaataatactgaaatagaacttacaaactgagattctagtgttttcacaaggacgatttattagtaaacaaataaaaaaattgagaaagtaaagttttgtgtatgaaagtaagtacactgttccagaaacgccatccctctgaatgtgttaggtaaggagctgagtggactgatgtttcatcagatttgctgagaataaatttggaatcacgtttccaccaaagtaattgcatatcctctagagcaatcgttcctaattttttcaaagatcctttttgaataccaagaaatttagtgaaaactcccacaaaattgaaaaaaatgcagaatatatgcatatagatgctcacaggtcttcacattgatccccagcctctcaagagtctgggtcctacttactggcttctgctgatcctatgttgtgatagacgtaaaattattacagaaacgattgtcccatgcaaacatcctagaacttgctcactgctcctattaaaacttcacagataactgtgcctacatcttatctgcctatgttagaaaataaatgtcctcttctttttcttcagtcttcatacatagtctactattgatgttttatgccctataaatttacctttctaatactctctaattaaatctaaaaactgcttgccttcttcttaagcatacagttgagttgtgagaacccatagacttcatgaagggcctttctatatgcaaacaataaatgtgataactgatcattcccaccattgggatgattatctacataaatcttaagtgcaccattgaaagccacattaaatcatcctgctggtccattgcattgtgggagataagtcagcacttttacatctttaactgaactgcagtatcccaggaaattcacaccctcgtctgcaaaaatctcccaaagaaatccaggccaaaattgaaccatgccaattctcaccgatcttgtaggcataagaatgcaatgtcctgctgcttccctagtcccttatatcatgaaaggtgcttccacaataaacgttatgcacttttaagaggcattttctaattcctaagcgctctaaaaaaaaaaaaaacttcgtactgacagatcaagaagactgtgggcggtttggtcattcttcttttcctgcctctggcacacctcaccacctacatattttcatgcatctggctttggatcatagaatcctagacattatttgggtggcatggattcatgaacacccataaacttggatgggggaaaaaatgacatctttattttcattaacttctaacttaaatttagtatttccttcaaatatgaatgcaggcagcaaacctagtctcagagactttatggccaagagaaatcacagatattttcatatcacattaagcttgtgcaggtatctcaaaatatttactctcatcactatttcaaaatttcagtcgctgttagagctgccatgagagcttgctgtttaatgtggtaataaagcccatatatcacaaccactaaatccccaatttgaggtatatatatatatttgattattatatttaaccattatattataattggtttccttagcaattctatgtattttattttatgcatttaaaaacattatttggagaaagagtccgtggcccttatctgatagccagaggtccagggcacaaagaagatttgctttcttccctgactcatcacggccacatcctccagtaccctgcattgttttcaatatactactttaaggagccctggatacctcctgtgtgccctgtgtcgtagggggctattcctgtttggcctctacagatgagatattctgagcagaaggtctgtccaggtgaccttatcttttttttttttttttaacttttgcaaatcttgtttattatagaaagattatagtggttaaaaagcttccagttttataagttgacctcaaaacagtgtaattgtgtgtgtgtgtgttttcttttctttaaattttttttataatttttatttttaattcaggggatgtatgtacaggtttgttacaggagtatatggcttgatgctgagacttgtggtgccactgatgctgagcatagcacccaataaatttttaaaccttgacctcctcctcccctcccacctctagtcgttcccagtggctattgttcccatctttatgtccatgagtcaggtgagctcatcttgatagtcaccccttgtgactttttttccacaccttacaggggaaatggcatggttctccaacggcctcccagtcgttagcaggaatgaatgagggcccttggagaacatttcatctgcctcctagttacagtcaagtcaatagaattccagagagcaacacaatggcctgcctcagattcccacagatagtgaattgccctgactagttaattagaaagttcttttctatatattacacatggacaaatacaatgactagcatttcggtgtattttttatttttttaattgacacataatagttgtattatgtattatgggatacagtgtatgatgtttcaatgcatatatacaatgtgtatttagcatatatacaaggtatttagcatatccatcacctcagacatccatcacttctttgtggcaagaccattcagaatcctctcttctgtcttctttgaaatatataccatagcattgtttactatcctcaccctactatgccatagaacaccagaacacattcctcctatctaactgcaaccttgcaccattgaccaatctcactccatcatccctcctccctaacccccaagcctcacacgactagtgttttttcatgctcattgtttaccaggtactgttctaagtgcttgacatgttaactcctttcattatcacagtggcccccattaggtaagttctataattattcatattttaaagatgaggagatagaggaagagagtggttaagagacttcctagtctacatcaagcagtgatgaagccaggatccacatcaggctgtcacttttcccccagcccctttactgtcctgcctcccaacccactaccaccacagagcatgtggaagctgattaaaaaacaaacaaacaaaaaataaaaccacctcagcaccaaactgagcagaggcaatccccccaaggtgtctttggcttgcagagatcaaacagttttctcatcatcttgtaaaatagggatacaaaggcctacctttcaggggtggtctgaaagttaaataaaacacatgtatcaagtgctaagtgtgttcagtgcataagttccccaaaacagtagttattacaatatttgctattatttttgtcaagatgtacacaaaagatagtggacaaagaagagatggatgatgaataacaaaccttcagggatatgggaatgagcagaaaatcatggtcaaagtataagagaggtcatgcaatccaacccacatttatgccagtctactgggcccctccaggctcctgaggtttaaaattgacctattgcctctgtcttcccctagatttgtccctgcaagtgtttcccttccttcgtgaaaattgccatattggccttctttcacctgctttcttacctccctcctccaagttccatccacaaatcctgtcaacccgccccagaaatatctcaaacagttcaaaacataattcaagcactgaatttaattccctttcaaaattagctccaggtgaccaaagaaaatccatatggatgctggaaaattggaaaggttgaaaacgacatttaaatgatattcaaggatttcccacatggaaagcaagaccagccagaataggagtctctggcccacaaccgccaaatgcaaggggaaacccacatgggaacaagtagcagggagcctcagcaaagccacccagcacttcctggcttgggaagtgtgagggatgtcagtctgttttgactatttcacctcctcacctccttctttgagggaactgtgcctattccactggtgtaattgcacaatgggttcttcttgtcctctgcacaaataaacccgttcactgagacagcatcattgcagcaaagaaagagtttaacacaagcctgaccaagcagaaggacagaagttttttattactcaaatcagcctccctgagaactcacaggctatggttttatggataatttgttgggcagggggctagggaatgggtgttgctgactggttggggatgaaatcttacgggtgtgataaatggtccttgtgtgctgaatctgtctctgggtgggggccacaggaatggttgagtgatgagccacaggtctgggtggggtcagttagttgccagaatgcaaaagtctaaaaaatatctcaaaagaccaatcttaagtttcacaatagtaatgttatctacaggaaccattggaaatatcacaaattttgtgacctcaggccacgtgattcctgagcagcaagggattacagaaagacaagcaagaggacaacagctggttaatgtttatctacacctacatcttagcagaatctagttccctcccataatcctaatcgtgtggcctttcatttgtcttacaaaggtagtttcagtcctcaaccaaagagaggatcagttttaggaagggaccattatcatccttgcttaaaacttaaattataaactacatttctcccatgggtagcttggcccatacccaggtataagcaaggccagccagctgtgagactagaagcaagaggagggtcagtcatgctagatatatcttgctgtcataatctttgcacaggtggtttcagtggggctcccaaccacaggatttgccataccctaaccacagaggtgggtatgagactgaggtaagtcaaatagactttccctcctgagaattcaaccttggttgagacacagagggatgagaaagggtagctgaaccattgtaataacaccaagatctccagaactgcactatgtctggctctcccatgggtgcagtccacggaatgtgagccgaagcacgggcatcgcctcacctgggaagcacaaggggtcagggaattccctttcctagccaagggaagccgtgacagatggtacctggaaaatcaggacactcccaccctaatactgcgcttttccaatggtattagcaaatggcacaccaggagattatatcccacacctggctctgagggtcccatgcccatggtccatcttcctttgattttataagatatctcagtgctcctggtgtttatttcactattatgtttcataacacatgtgtacactacatatatccttcaataatacataaatcaatatttcataatcaacattaaagaataaaagagccaaaacaagagaattttaaaatatttgctctcagatagtggggataggacttgctacagactcgaatgaaaggaaagaattatgtgctaattctgctaaggaaaatggaaaccattaaaatgccttaaaagaactaaagaaatgaaaactctaaccaggtaagaaagggagttagtgggatctcagtgaggttgaagactccacacctcttacacttaactaaaacactgaaccctatggacatgggctgctagatcatctcattgaaggatgtggtctaggagacccaatagtttctttataggcaaccattaaaaagaccagcatgtctatttcatccacaggaagacccgagcatccaaggcatgaatcacacaacaaattctcttcaagaaaagcaacgaggttccaagatggctgaataggaacagctccagtctatagctcccagtgtgagcgatgcagaagatgggtgatttctgcatttccaacagaggtaccaggttcatctcactggagcttgtcagacagtgggtgcagtccacggaatgtgagccgaagcaggggcatcgcctcacctgggaagcacaaggggtcagggaattccctttcctagccaagggaagccgtgacagatggtacctggaaaatcaggacactcccaccctaatactgcgcttttccaatggtattagcaaatggcacaccaggagattatatcccacacctggctctgagggtcccatgcccatgaagcctcgctcagggctagcacagcagtctgagatcaaactgcaaggtggcagcaaggctgggggaggggcgtccaccattgctgaggcttcagtaagtaaacaaaatgcccaggaagctcgaaccgggtggagcccaccgcagctcaaggaggcctgcctgcctctgtagactccacctctgggggcagggcatagccaaacaaaaggcagcagaaacctctgcagacttaaatgtccctgtccgacagctttgaagagagtagtggttctcccagcatggagtttgagatctgagaatggacagactgcctcctcaagtgggtaactgaccgaaaagcagcctaactgggaggcacctcccagtaggggccaactgacacctcatacggccgggtgcccctcgagatgaagcttccagaggaaggatcaggcaccaacatttgccattctgcaatatttgttattttgcagccttagctggtgatacccaggcaaacagggtatggagtggacctccagcaaactccaacagacctgcagctgaggtgcctgactgtcagaaggaaaactaacaaacagaaaggacatccacaccaaaaccccatctatacgtcaccatcatcaaagaccaaaggtagataaaaccacaaagctggggagaaaccagagcagaaaaactgaaaattctaaaaatcagagcgcctcttctcctagaaaggaacgcaactccttgccagcaatggaacaaagctagatggagaatgactttcacgagttgagagaagaaggattcagacgattagtaaacagaaacttctctgagctacatgaggatgttcgaaccaatcacaaagaagataaaaaccttgaaaaaagattagatgaatggctaactagaataaacagcatagagaagaccttaaatgacctcatggagctgaaaaccacggcacaagaactacgtgatgcatgcacaagcttcagccgccgattagatcaagtggaagaaagggtatcagtaattgaagatcaaatgaatgaaaagaagcgagaagagaagtttagagaaaaaggagtaaaaagaaatgaacaaaggctccaagaaatatgggactatatgaaaagaccaaatctacatctgattgatgtacctgaaaatgacgcggagaatggaaccaatgtggaaaacattctgcaggatattatccaggagaacttccccaacctagcaaagcaggccaacattcaaattcaggaaatacagagaatgccacaaagatactccttgagaagagaaactccaagacacataattgtcagatttaccaaggttgaaatggaggaaaaaatgttaagggaagccagagagaaaggctgggttacccacaaagggaagcccatcaaactaacagcagatctctctgaagaaactctacaagccagaagagaatgggggccaatattcaacattcttaaagaaaagaattttcaacccagaatttcatatccagccaaactaagcttcatagtgaaggagaaataaaatcctttaaagacaagcaaatgctgacagattttgtcagcaccaggcctgccttacaagagctcctgaaggaagcactaaacatggaaaggaacaactggtacaagccactgcaaaaacatgccatcgtaaagaccatcgatgctaggaagaaactgcatcaacgaacgagcaaaataaccagctaacatcataatgacaggatcaaattcacacataacaatattaacctttaatgtaaatgggctaaatgcccccagttaaaagacacagactggcaaattggataaagagtcaagacccatcagtgtgctgtattcaggagacccacctcatgtgcagagacacacataggctcaaaataaagggatggaggaagacctaccaagcaaatggaaaacaaaaaaaaagcaggagttgcaatcccactctctgataaaacagactttaaaccaacaaagatcagaagagacaaagaaggcaattacattatggtaaagagatcaattcaacaacaagagctaactatcttaaatatatatgcaccaaatacaggagcacccagattcataaagcaactcattagagacctaaaaagagacttagactcccaaacaccccactgtcaacattagataaatcaatgagacagaaagttaacaaggatatccaggacttgaactcagttctgcaccaagcagacctaatagacatctacagaactctccaccctaaatcaatagaatatacattcttctcagcaccgcatcatgcttattccaaaattgaccacatagttggaagtaaagcactcctcagcaaatctaaaagaacagaaattataacaaattgtctctaagaccacagtgcaatcaaactagaactcaggtttaagaaactcactcaaaaccacacgactacatggaaactgaacaacctgctcctgaatgactactgggtatacaacaaaatgaaggcagaaataaagatgttctttgaaaccaatgagaacaaagacacaacgtaccagaatctctgggacacatttaaagcagtatgcagagggaaatttacagcactaaatgcccacaagagaaagcaaaaaagatctaaaatttgacaccctaacatcacaattaaaagaactagagaagcaagagcaaatacattcaaaagctagcagaaggcaagaaataactaagatcagagcagaactgaaggagatagagacacaaaaaaaaccttcaaaaaatcaatgaatccaggagctggttttatgaaaagatcaacaaaattaatagaccactagtgagaataataaagaagaaaagagagaagaatcaaatagatgcaataacaaaagataaaggggatattaacaccgatcccacagaaatacacactaccatcagagaatactataaatacctctatgcaaataaactagaaaatctagaagaaatggataaattcctggacacatagaccctcccaagactaaaccaggaagaagttgaatctctgaatagaccaataacaggctctgaaattgaggcaataattaatagcctaccaaccaaaaaaagtccagaaccagacggattcacagccaaattctaccagaggtacaaagaggagctggtaccattccttctgaaactattccaatcaatagaaaaagagggactccttcctaattcattttatgaggccagcatcatcctgataccaaaggctggcagagacacaacaaagaaagagaattttaaaccaatatccctgatgaacatcaatgcaaaaatcctcaataaaataccggcaaaacgaatctagcagcacttcaaaaagcttatctaccacgatcaagtttgcttcatccctgggatgcaaggctggtttaacatatgcaaatccaaaaacgtaatccaacatataaacagaaccaaagacaaaaaccacatgattatctcaatagatgcagaaaaggcctttgacaaaattcaacagctcttcacgctaaaaactcgcaataaactaggtattaatgggatgcatctcaaaataataagagctatttatgacaaacccacagccaatatcatactgaatgggcaaaaactggaagcattccctttgaaaactggcacaagacagggatgccctctctcaccactcctattcaacatagtgttggaagttctggccagggcaatcaggcaggagaaagaaataaagggtattcaatcaagaaaaaaggaagtcaaattgtccctgtttgcagatgacatgattgtatctttagaaaactccatcgtctcagcccaaaatctccttaagctgataaacaacttcagcaaactctcaggatacaaaatcaatgtgcaaaaattacaagcattcctatacaccaacagcagacaaacagagagccaaatcatgagtgaaccccctttcacaattgcttcaaagagaataaaatacccagaaatccaacttacgaagtatgtgaaggacctcttcaaggagaactacaaaccactactcaatgaaataaaagacacaaacaaatggaagaacattccatgctcatgggtagaaagaatcaatattgtgaaaatggccacactgcccaaggtaacttacagattcaatgccatccccattaagctgccaatgactttcttcacagaattggaaaaaactactttaaagttcacatggaaccaaaaaagaaccttcattgccaagacaaacctaagccaaaagaacaaagctggaggcatcacactacctaacttcaaactatactacaaggctacagtaaccagaacagcatggtactggtaccaaaacagagatatagaccaatggaacagaatagagccctcagaaataataccacacatctacaatcatctgatctttgacaaacctgacaaaaacaagaaatggggaaaggatttcctacttaataaatggtgctgggaaaactggctagccatatgtagaaagctgaaactggatcccttccttacagcttccacgaaaattaagtcaagatggattaaagacttaaatgttagacctaaaaccagaaaaaccctagaagaaaacctaggcaataccagtcaggacataggcatgggcaaggacttcatgtctaaaacatgaaaagcaatggcaacaaaagccaaaattgacaaatgggatctaattaaactaaagagcttctgtacagcaaaagaaactaccatcagagtgaacaggcaacctacagcaagggagaaaatttttacaatgtacccatctgacaaagggctaatatccagaatctacaaagaacttaaacaaatttacaagaataaaatcaaacatccccatcaaaaagtggacaaaggatatgaacagacacttctcaaaagaagacatttatgcagccagcagacacatgaaaaaatgctcatcatcactggccatcagagaaatgcaaatcaaaaccacagtgagataccatctcacaccagttagaatggcgatcattaaaaagtcaggaaacaacaggtactggagaggatgtggagaaataggaacacttttacactgttggtgggactgtaaactagttcaaccattgtggaagacgtgtggtgattcctcaaggatctagaactagaaataccattagaactagaaatgccatcccattactgagtatatacccaaaggattataaatcatgctgcaataaagacacatgcacacgtatgtttattgcggcactattcacaatagcaaagacttggaaccaacccaaatgtccatcaatgatagactggactaacaaaatgtggcacatatacaccatggaatactatgcagccagaaaaaaggatgagttcatgtcctttgtagggacatggatgaagctggaaatcatcagtctgagcaaactatcacaaggacagaaaaccaaacacagcatgttctcactaataggtgggaattgaacaatgagaacacttggacacaggatggggaacgtcacacatcagggcctgttgtggggtggggtgagggggaagggatagcattaggaaatatacctaatgtaaatgacaagttaatgagtgcagcacaccaacatggcacatgtatacatatgtaacaaacctgcacattgtgcacatgtacactagaacttaaagtataattttttaaaaaaaaaagaaaggaaaagcaacatctttctgcttaggatgagagcctaatatacttggaatgataaaacttctttttcagtgagtatcattttacccttggaaccttccaaggtttcaaggtattttaacacgcaagtattttaagtattttaaggtagattacacacatcttaacacctaccctataatacttgagcacacacagtgtgatgccataatatgttagtttaagttataaactaggcacagccagtggcctgatggagactccctagccagtcagcaggtcaccagcaaatccacacaccagagagggctacagtaagagcgtcagccaggcacatcttcatcaacatcaaaggcttttctaactgacctagtgaagatcagtggtttctgttggtggaattaatggtattcaagttgtatgatagagtaagatatttcagtaaatatccccacacttcatgaacagcacaagcatcccaggaaatgatgccactcaacatttaatgtcccaagagtcccaggtcccccaccaagtcaggagcagtctggactgcagataccatcatatctaccttagatgaacctgccatgcaatcggtcagactacgcacaagacagagaacatacaaaaaatgacccgtataggagataacgcatatgttaattagctcaattcagccattacacaatttatacatattttaaaacatcatgttatacatgacaaatatatacaactttgtgaattttttagttactttttttaagaaaacagaatagggacttcactgagctcacaggcttgataataagtgttcattacatgtccagatggagggaagagtttggtcagccacgtgctttgcctataacctggttgtgccactgtcttccacctaaaagaacctgagagtttctgataatcaaacaggaaagctcaccacaaaaggttagaatagcaatgcctttatgttacattaaataataatctgcatatgttcagtatttatagtgtttagggataattttgtctataaaaaccaacagattagctttatgattccattaaaatgtacttattttctatttgagattttaagctgaaagatttaagggtcttgtctaggtttgtacacagcattggatgcttaagataacttgagatttactatattcataagattaatttattacattacctacagaggggaaatcaaatatattatatttataaatgcaataaaaatgtttaaaggaatttaattaaccaagttgtaaatggggctgattatttaaggtagttttctctgttcagctggaacactaagaaaagcgtccttgaacaggattgctgaaattcactggatttataaaaagaacaataagatttataagtggcacttctatgggcttaaggaaaacaagactttttaatttattatttgaataaattgtaaacgaattcataataaaagtccaaaataaatgtaaatcattcctttcgggggggaaattaccttaaagaccaaaaaactcacagcaacagatcagaactatgaatcattattaattgagatgttggcattattctcccacagaaagaatcacagcattctacaacagttgttgcccaactcttttgattatgcacccctaatagtaaaagaagtttgaaaatgtatctgtaatatatgtatatttattgacacattgtgatgggcactgccacgcactgcccagagtccccagagaaggacatgttgccctgtgctgtgggcagagagcccccagtgatcagttcttcagggatgctgcaactgcagagggccacctggatgaatgcatgtccctctcaagacagcctatatgcagtgactcatccgtgcaggtatataaaggcctggccacctgggcccagctctagagagctctgaagggccattctagctcccatgctctgcatggcgttgacccaggctgtcacagagcctgtgtcacagatggacctctccttctgctccaccctgattccttctgtccttcgtacagatgtcaatgcccaggttatgccctagcaaacatcccacatgctccactccttcccagagtctacttcccaggaaacccaacctgtaacacaaactacatatgcaaacatctcaattactttgttaaacattagcaaagcttaatatctttatgatttgaatacctcagcctcggaaatggtagtgaggagaccagaatgctaatgagccataaagtatggataattgagagattacccttgtcatatccattatggctgctataagaaagtatctcacgaggtaatttataaaaacaaatttatttctcacacttctgaagactgagaaatccaagacaaagatccactgccagatccactgtctagtgagggctcgctttttgcttcaaagatggcacattctaggttccctcacttggcaggaaggggcaaagaaactccctcaaacacccagagggcagggcatgcggccccaccaacccctaccactgatagtcaggtgggaatgccagagcttccagcccaatgatcttgcttctgtgtgaactcagctagaggccacaacttcctgttgtcccaggagaaactcaatggcagagcatgctacctcgcccactccctccacaggtagccaggtgggtaggcaacacctgctacagcttctggcccagtggtcccacttctgtgtgaactcagccagtggatacagcctcctattgtaccatgaagcacccagacagcagggcaggtgcctccatccacctctaccacagggagtcaggtgagccatgcctgctagagcttccagcccaacagtcctacttctgcctgaatttgccaagaggcacaacttcctgttgccctgggaacaccaggatggcagggtaggcaactctccccacccttgcttcctacagccagaagggccacacccactagagcttccaacccagtggccctacttctgcctgagctctgccggaaggtacaaacctgtgtttccccaggaagcaaacaaacatcagattagggccaatctaggaaggataaggcttatctgccaactgtggcccctgcttgacagagtctcatggaccaaaacacccaacaaaaaaacatgggcatggagacagtaattggagggggctcctccaaagagcctgtagcagactagaactgaaaccagtcaaccaaacccaccttacaccatcatcaaatccccaagggcatcaaagaagcaaaaagcaaaaaaaaaaaaaaaaaactatccaatttatctttgaaggatagcaacttcaaagattgaaggaacatcaggtcacacaaatcagaaagaaccacagcaagaactctggcaactcaaaaagccagagtggcttctttcctccaatgaccacactagttccccagtgtattagtccatttacacactgcaataaagaactacctgagactgggtaatttatgaagaaaagaggttcaactgaatcacagttctgcaggcttaacagggagcatggctggaaggcctcaggaaacttataatcatggcagaaggggaaggggaagcaagtacatctttactgtggcagagcaggagagggagagagagagaaagaggagggggaagtgacaaacacttttaaaccatcagctctcatgagaactcactcactatcactaaaacacctcccaccaggcccctcctccaattcgacatgagatttgggtggggacacaaatccaaatcatatcacccagcaagggttcttaaccaagctgaagtggctgaaatgacagaaatagaattcagaatatggataagaatgaagatctttgagattcaggagaatgtcaagactcaatccaaggaagttaagaatcacaataaaataatacaggagctcatagacaaaataaccattataaaaaagaagcaaactaatctagtagagctgaaaaatatactataagaattgcataatgcaatcacaagtattaacaacagaacagactaagctggggaaacaatctcagagtttgaagactggctgtctcatataactcaatgagacaaaaataaagaaaaaagaatgaacaacacctctgagaaatacagaattatgtaaagaaaccaaatcgatgattcactggcatcctcaaaagagatgaggagaaggcaggcaatttggaaaacatatttcaggatagcatttattaaaacttcactacagaggccaacattcaaattcaggaaatgcagagaacccctgtgaggttatacaagaagagcatccagaagatacataatcagattccacaggctgaaatgaaagaagaatcattaagggtaactagagacaagggacaggtaacctacaaagggaatcccatcaagctaagagtggacctttcagcagaaatgctgcaagccagaagagactgggggtctatattcaggattcttaaagaaaaaatgtttaaccaataatttcatttccagtcaaactaagctccgtaagtgaaggagaaataagattcttttcagacaagaaaatgctgagggaatttgttaccaccagacctgccttacaagaaatcctgaaaggagcaataaatatgtaaaggaaagaccattaccagcccctacaaaaacacacttaagtacatagacaggtgacactaaaaagccaccacacaaataagtctgcataataaccagccaacaacacaaacacatgatcaaatccacaaaaatcaatattaatcttgaaagtaaatgggctaaatgccccaattaaaaggcacagagtggcaagctagataaaaaagcagggcctaatggtatactgtcttcaagagacccatctcacatgcaatgacatccatagcctcaaaataaagggatggagaaaacatatcaagaaaatggaaaacagaagaaagcaggggttgcagtcctaatttcagagaaaacagactttaaaccaacaaagatcaaaagagataaaaaggggattatatagtggtaatgggttcaattcaacaagaagatctaactgttttaaacatacacacaactaacacaacaacacccagattcataaggcaagtttttagaaatctatgaagagacttatattaccacacagtaatagtaggtgacttcaacacctcaatgacagtataagacagatcactgagacagaaagttatttgggacctgaactcaacacttgaccaaatggacctaacagacatctaaagaactctccaccgaaacacaatagaatatacattcttctcaacaccacatggcacacactccaaactcgaccacaccatcagacataaaacaatactcagtaaattttttaaaaaatgaaatcatacccaaccacactctcagaccacagcacaataaaaatagaaatcaatagtaagaaaattactcaaaagcatacaatgtggggggcggttccaagatggctgaataggaacagctgcagtctatagctcccagtgtgagcgacgcagaagacgaacgatttctgcatttccaattgagataccaggttcatctcactcgggattgtcggacagtgggtgcacaacagtgggtgcagcacaccgagcgtgagccgaagcagggtgaggcagtgcctcacccaggaagcacaaggggtcagggaattccctttcctagccaaggaaaggggtgacagacagcacctggaaaatcaggtcactcccaccctaatactgtgcttttccaacggtcagcaaatagcacaccaggagattatatcctgtgcctggctcagagggtcctatgctcacggagcctcactcattgctagcacagcagtctgagatcaaactgcaagggggcagcgaggctgggggagagacgcccaccactgctgaggcttgagtaggtaaacaaagcggccaagaagatcaaactgggtggagcccaccacagctcaaggaggcctgcctgcctctgtagactccacctctgggggcagggcatagccaaacgaaatgcagcagaaatctctgcagacttaaatgtctctgtctgacagctttgaagacagtagtggttctcccagcacgcagcttgagatctgagaacagacagactgcctcctcaagtcagtccctgacccccaagtagcctaactgggaggcaccccccagtaggagcagactgacacctcacatggccggctacccctctgagatgaaacatccagaggaatgatcaggcagcaacatttgctgtacaccaatattccctactctgcagcctctgctgctgatacccaggcaagcagcgtctggagtggacctccagcaaactcgaacagtcctgcagctgagggtcctgactgttagaaggaaaactaacaaacagaaaggacatccacaccaaaaccccatctgtacgtcaccatcatcaaaaaccaaaggtagataaaaccacaaagatggggaaaaaacagatcagaaaaactgaaaattctaaaaatcaaagcacctctcctcctccaaaggaatgcagctcctcaccagcaatggaacaaagctggatggagaatgactttgacgagttgggagaagaaggcttcagatgatcaaacttctctgagctaaaggaggaatttcgaagccatggcaaacaagttaaaaaccttgaaaaaagattagatgaatggctaactagaataaccaatgcagagaagtccttaaaggacctgatggagccgaaaaccacggcacaagaactatgtgatgaatgcacaagcttcagtagccgatttgatcaactggaagaaagggtatcagtgacggaagatcaaatgaatgaaatgaagcaagaagttaagtttagagaaaaaagaataaaaagaaatgaacaaagcctccaagaaatatgggactatgtgaaaagaccaaatctaggtctaattggtatactgaaagtgacgaggagaatggagccaagttggaaaacactctgcaggatgttatccaggagaaattccccaacctagcaaggcaggccaacattcaaattcaggaaatacagagaatgccacaaagatactcctcgagaagagaaactccaagacacataattgtcagaatcaccaaagttgaaatgaaggaaaaaatgttaagggcagccagagagaaaggttgggttaaccacaaagggaagcccatcagactaacagcttatctctctgaagaaactctaaggccagaagagagtgggggccaatattcaacattcttaaaggaaagaattctcaacccagaatttcatatccagccaaactaagcttcataagtgaaggagaagtaaaatactttacagacaagcaaatgctgagagattttgtcagcaccaggcctgccttacaagagctcctgaaggaagcactaaacatggaaaggaacaactggtacaagccacagcaaaaacgccaaattgtaaagaccatcgatgctaggaagaaactacatcaactaatgagcaaaataaccagctaacatcataatgacaggatcaaattcacacataacaatattaactttaaatgtaaataggctaaatgctccaattaaaagacacagactggcaaactggataaagagtcaagacccatcagtgtgctgtattcaggagacccatctcatgtgcaaagacacgtataggctcaaaataaaggaatggaggaagacctaccaagcaaatggaaaacaaaataaggcaggggttgcaatcctagtctctgataaaacagattttaaaccaacaaaaatcaaaagagacaaagaaggccattacataatggtaaagggatcaattcaacaagaacaactaactatcctaaatatatatgcacccaatacaggagcacccagattcataaagcaagtccttagacacctacaaagtgacttagactcccacattataataatgggagacattaataccccattatcaacattagacagatcaacaagacagaaagttaacaaggatatccaggaatggaactcacctctgtacaaagcagacctaatagacatctacagaactctccaccccaaatcaacagaatatacattcttctcagcaccacgccacatttttccaaaattgaccacatagttggaagtaaagcactcctcagcaaatgtaaaagaacagaaattgccaggcgcggtggctcacgcctgtaatcccagcactttgggaggccgaggcgggcggatcacgaggtcaggagatcgagaccatcccggctaaaacggtgaaaccccgtctctactaaaactacaaaaaatagccgggcgtagtggcgggcgcctgtagtcctagctacttgggaggctgaggcaggagaatggcgtgaacccgggaggcggagcttgcagtgagccgagatcccgccactgcactccagcctgggcgacagagcgagactccgtctcaaaaaaaaaaagaacagaaattataacaaactgtctctcagaccacagtgcattcaaactagaacttgggattaagaaactcactcaaaaccacacgactacatggaaactgaacaacctgctcctgaatgactactgggtacataacgaaatgaaggcagaaataaagatgttctttgaaaccagtgagaacaaagacacaacataccggaatctctgggacacatttaaagcagtgtgtagagggaaatttatagcactaaatgcccacaagagaaagcaggaaagacctaaaattgacaccctaacatcacaattaaaagaactagagaagcaagagcaaacacattcaaaagctagcagaaggcaagaaataactaaaatcagagcagaactgaaggaaatagagacacaaaaaacccttcaaaaaatcaatgaatccaggagctgtttttttaaaaagatcaacaaaattgatagaccgctagcaagactaataaagaagaaaagagagaagaatcaaatagatgcaataaaaaatgataaaggagatatcaccaccaatcccacagaaatacaaactaccatcagagaatactataaacacctctactcaaataaacttgaaagtctagaagaaatggataaattcctcgacacatacaccctcccaagactaaaccaggaagaagttgaatctctgaatagaccaataacaggttctgaaattgaggcaataattaatagcctaccaatcaaaaacgtccaggaccagatggattcacagctgaattctaccagaggtacaaggaggaactggtaccattccttctgaaactattccaatcaagagaaaaagagggaatcctccctaactcattttatgaggccagcatcatcctgataccaaaacctggcacagacacaacaaaaaaagagaattttagaccaatatccctgatgaacatcgatgcaaaaatcctcaataaaatactggcaaaccgaatccagcagcacatcaaaaaacttacccaccatgatcaagtgggcttcatccctgggatgcaaggctggttcaacatacacaaatccataaacttaatcctgcatataaacagaaccaaggaaaaaaaacacatgattatctcaatagatgcagaaaaggcctttgacaaaattcaacagcccttcatgctaaaaactctcaataaattaggtattgatgggatgtatctcaaaataataagagctattatgacaaacccacagccaatatgatactgaatgtgcaaaaactggaagcattccctttgaaaactggcacaagacagggatgccttctctcaccacgcctattcaatatagtgttagaagttctggccagggcaatcaggcaggagaaggaaataaagggtattcaattaggaaaagaggaagtcaaattgtccctgtttgcagatgacatgattgtatatctagaaaaccccattgtctcagccccaaatctccttaaactgataagcaacttcagcaaagtctcaggatacaaaatcaatgtgcaaaaatcacaagcattcttatacaccaataacagacaaacagagagccaaatcatgagtgaactcgcattcacaattgcttcaaagagaatacaatacctaggaatccaacttacaaaggatgtgaaggacctcttcaaggagaactacaaaccactactcaatgaaataaaagaggatacgaacaaatggaagaaaattccatactcatgggtaggaagaatcagtattgtgaaaatggccatactgcccaaggtaatttatagattcaatgccatccctatcaagctaccaatgactttcttcacagaattggaaaaaactactttaaagttcatatggaaccaaaaaaaaaagcctgcattgccaagtcaatcctaagtcaaaagaacaaagctggaggcatcatgctacctgacttcaaactatactacaaggctacagtaacaaaaacagcatggtactggtaccaaaacagagatatagaccaatggaacagaacagaggcctcagaaataccaccacacatctacagccatctgatctttgacaaacctgacaaaaacaagcactggggaaaggattccctatttaataaatggtgctgggaaaactggctagccatatgtagaaagctgaaactggatcccttccttacagcttatacataaattaactcaagatggattaaagacttaaatgttagacctaaaaccagaaaaaccctagaagaaaacctaggcaataccagtcaggacataggcatgggcaaggacttcatgtctaaaacaccaaaagcaatggcaacaaaagccaaaattgataaatgggatctaattaaactaaacagcttctccacagcaaaagaaactaccatcagagtgaacaggcaacctacagaatgggagaaaatttttgcaatctactcatctgacaaagggctaatatccagaatctacaaagaactcaaacaaatttataagaaaaaaacaaccccatcaacaagtgggtgaaggatacgaacatacacttctcaaaagaagacatttatgcagccaacagacacatgaagaaatgctcatcatcactggtcatcagagaaatgcaaatcaaaaccacaatgagataccatctcacaccagttagaatggtgatcattaaaaagtcaggaaacaacaggtgctggagaggatgtggagaaataggaacacttttacactgttggtgggactgtaaactagttcaaccattgtggaagtcagtgtggcaattcctcaaggatctagaactagaaataccatttgacccagccatcccattactgggtatatacccaaaggattataaatcatgctgttataaagacacatgcacacatatgtatactgtggcactattcacaatagcaaagacttggaaccaacccaaatgtccaacaatgatagactggactaacaaaatgtggcacatatacaccatggaatgctacgcagccataaaaaaggatgagttcatgtcctttgtagggacatggatgaagctggaaaccatcattctcagcaaactatcacaaggacaaaaaaacaaacactgcatgttctcactcataggtgggaattgaacaatgagaacacatggacacaggaaggggaacatcacacagtggggcctgttgtggggtggggggaggggggagggatagcattaggagatatacctaatgtaaatgacgagttaatgggtgcagcacaccaatatggcacatgtatacatatgtaacaaacctgcacgttgtgcacatgtattctaaaacttaaagtataataaaaaataaaaataaaaaaataaaaaataaaaaaaagcatacaatgacatggaaattaagcaacctgcccctgaatgacttttaagtaaataataaaattaaagaagaaatcaagaaattctttgaaactaatgaggacaaagataaaacataccagaatctctgggacataactaaagcagtgtcaagaggaaagtttatagcactaaaagcccacatcaaaaagttagaaagatctcaaattaacaatctaacatcagaactagaagaactagaggagcaagagcaagctcaccccaaaactaacagaaaacaggaaacaaccaaaatcagagctgaactgaagaagattgagaagcaaaaaaaaaaaaaacgtattaaaaaaagagattaatgaatttaagagttggttctttgaaaaaataagacagagaaaccacgagctagactaaaaaattttaaaaaagattcaaataaacacaattagaaatgacaaaagggacattaccactgacctcacagaaatacaaaaaaaaaaatcagggactactatgaatatatgcagacaaactagaaaatctagaagaaacagataaattcctggacacatacaacttcccaaagctgaaccaggaagaaattgaatccctgaacagaccaataacaagttctgaaattgaatctgtaataaaagcctactaaccaagaaaagcccagaaccagttggattcacagtagatttctactagatgtataaggaagagctagtaccattcctactgaaactattccaaaaaaaattgaggagggagaactcctccctaactcactctatgaggccagaatggcagaaacacaacaaaaaaagaaagcttcaggccaacttccttgatgaacacagatgcaaaaatcttcaacaaaatactagcaaaccaaatccagtagcacatcaaaaaggtaatcgacaacgatctagtagcctttttccctgggatacatggttgattcaacatatgcaaatcaataaatgtgattcatcacataaacagaactaaaaataaaaactgtgattatctcagaaaagactttcagtagaatttaacatccattcatgttataagctcttaataaactaggcatcaaaggaacacacttcaatataataagagtcatctatgagtaagccacagccaacatactgagtgggcaggaaacattctccttgaaaaccagaacgagacaaggataccctctcttaccactcctattcaatacagtattggaagtgctggccagagcaatcaggcaagagaaagaaaaggcatccagagagaaagagagtatgtcaaagtatccctgcttacagaaaacatgattctatctctagaaaaccccatagtttctgcccataatctccttgatctgataaacaacttcagcaaagtttcaggatacaaacttaatgtacaaaaatcagtagcattcctatacaccaagatccaaaccaagagccaaatcacaaatgaaactgcattcacaattgccacaaaaaataaaatacctaggaatacacctaaccaggcaggtgaaaggcctctacaacaagaattacaaaacactgctcaaagaaatcagcaaaaacacaagcaaatggaaaaacattacatacttatggacaggaagaatcaatatcactaaaatggccattctgcccaagacaatttacagattcaatgctatttctatcaaatgactgatgacattcttcacagaactagaaaaactattaatattttaaaattcatatagaacaaaaaaagcccaaatagcaaaggcaatcctaagcaaaaataagaaaactggaggcatcatgttacccaacttcaaagtatactacagggtactggtaaccaaacagcatggtacttgtacaaaaatagacacatagaccaaaggaagtgaacagagaacccagaaataatgctgcacacctatgaccatctgatcttcgacaaaccttacaaaaataagcaatagagaaagcatttcccatttaataaatggtactgggataaatggctaggtatatatgcagagattgaaactggacctctttcttttgcatccaaaaaataacaaatgtatactttaatttctaaaataggtgtcttgacatgtgcacaactgtattttcctagtgcaaactttcccattgattattataatttttaaaaattatactttaagtactagggtacatgtgcacaatgtgcaggttacatagatatatgtttcatgttggtgtgctgcacccatcaactcgtcatttacattaggtatttatcctaatgctatccctcccccagccacacaccccacaacaggccccagtgtgtgatgttccccgccctgtgtccatgtgctctcattgttcaactcccacttatgagtgagaacatgtggtgtttggttttctgtccttgtgatagtttgctgagaatgatggtttgcagcttcatccatgtctctgcaaaggacatgaactcatccttttttatggctgcatagtattccgtggtgtatatgtgccacattttcttaatccagtctatcattgatcagcatgtgggctggttccaagtctttgctattgtgaagagtgctgcaataaacatacatgtgtctttataacagcatgatttataatcctttgggtatatacccagtaatggaatggccgggtcaaatggtatttctagttctagatccttgaggaatcgccacactgtcttccacatcagttgaactaatttacactcccaccaacagtgtaaaactattcctatttctccacatcctctccagcacctattgtttcctgactttttaatgatcgccattctaactggtgtgagatggtatctcattgtggttttgatatgcatttctctgatgaccagtgatgatgagcattttttcatatgtctgtgggctgcataaacgttttcttttgagaagtgtccattcatatcctttgcccattttttgatggggttgtttttctcttgtaaatgtgagttctttgtagattctggatattagccctttgtcagatggataggttgcaaaaattttctcctattctgtaggttgcctgttcactctgatggtagtttcttttgctgtggagaagctgtttagtttaattagatcccatttgtcaattttggcttttgttgccattgcttttggtgttttagtcatgaagtctttgcccatgcctatgtcctgaatggtattgcctaggttttcttctagggtttttctggttttaagtcttacatttaagtctttaacctatcttgacttaattttcatataagctgtaaggaagggatccagtttcagctttctacatgtggctagccagttttcccagcaccatttattaaatagggaatcctttccccagtgcttgtttttgtcaggtttgtcaaagatcagatggctgtagatgtgtggtggtatttctgaggcctctgttctgttccattggtctatatctctgttttggtgccagtaccatgctgtttttgttactgtagccttgtagtatagtttgaagtcagatagtgtgatgccctggctttgttctttttgcataggattgtcttggctatgtgggctcttttttggttccatatgaactttaaaatagatttttccaattctgtgaacaaagtcattggtagcttgatagggatgacattgaatgtataaattaccttgggcagtatggccattttcatgatactgattcttcccatccaggagcatggaatgttcttcaatttgtttgtgtccccttttacttcatagagcagtggtttgtagttctccttcaaaaggtccttcacatcccttataagatggattcctaggtattttattctttttgtagtaattgtgaatgcgagttcactcacgatttggctctctgtttgtctgttattggtgtataagaatgcttgtgatttttgcacattgattttgtatcctgagactttgctcaagttgcttattagcttaaggagatttggggctgagacaatggggttttctaaatatacaatcatattatctgcaaacggagacaatttgatttccttttttcctaactgagtaccctttatttctttctcttgcctgattgccctggccagaacttccaacgctatgttgaataggagtggtgagagagggcatccttgccttgtgtcagttttcaaagggaatgcttccagtttttgcccattcagtatggtactggctgtgggtttgtcataatagctcttattattttgagatatgttgcatcaatacctagtttattggcagtttttagtatgaagggctgttgaattttgtagaaggccttttctgcatctattgagataatcatgtggtttttttccttggttctgcctatgtgatggattacatttattgatttgtgtatgttgaaccagccttgcatcccagggatgaagccaacttgatcatggtggataagctttttgatgtgctgctggattccttttgccagtattttattgagcatttttgcattgatgttcatcagggataatggcctaaaattctcttttttgttttgtttctgccaggctttggtatcaggatgatgctggcctcataaaatgagttaggaaggattctctctttttctgttgtttggaatagtttcagaaagaatggtaccagcttctctttgtacctctggtagatttcggctgtgaatccatctggtcctggaattttttttatttgtaggctattaattattgcctcaatttcagaacctgttattggtctattcagagattcaacttcttcctggtttagtcttgggagggtatatgtgtgcaggaatttatccatttcttctagattttctagtttatttgcaaagaaatgtttatagtattctctgacggcagtttgtatttctgtggggtcagtggtgatatcccctttatcattttttattgcatctatttgattcttctctcatttcttctttgttagtcttggtagcagtctattttgttgatcttttcaaaaaaccagattcattgatttttttgaagggtttttcatgtctcttcagttctgctctgatcttagttggttcttgccttctgctagcttttgaatttgttttctcttgcttctctagttcctttaattgtgatgttagggtgtcaattttagatctttcctgctttctcttgtgggcatttagtgctataaatatccctctacacactgctttaaatgtgtcccagagattctggtatgttgtgtctttgttctcacgggtttcaaagaacatctttatttctgccttcatttcattatttacccagtagtcattcaggagcaggttgttctgtttgcatgtacttgaacggttttgagtgagtttcttaatcctgcgttctaatttgattgcactgtggtctgagagacagtttgttgtgatttctgttcttttgcatttgctgaggagtgctttacttctaactatgtggtcaattttagaataagtgcgatgtggtgctgagatgaatgtatattctgttgatttgggatggagagttctgtagatgtttattaggtctgcttggtacagagctgagttcaagtcctggatatccttgttaaccttctgtcttgttgatctgtctaatattgacagtggggtgttaaagtctcccattattattgtgtgggagtctaagtctctttgtaggtctctaaggacttgctttatgaatctgggtgctcctgtattggatacatatatatttaggatagttcactcttcttgttgaattgatccctttaccataatgtaatggcctcctttgtctcttttgatctttgttggtttaaagtctgttttatcagagactaggattgcaacccctgctttatttgctttccatttgcttggttgatcttcctcattccctttattttgagcctatgtgtgtctttgcacatgagatgggtctccggaatacagcactctgatgggtcttgactctttatccaatttgccagtatatgtcttttaattgggggcatttagcccatttacatttaaggttaatattgttatgtgtgaatttgatcttgtcattatgatgttagctggttattttgcccattaattgatccagtttcttcatagtgtcaatggtcttcacaatttggtatgtttttgcagtgtctggtactggttgttcatttccacgtttagtgcttccttcaggagctcttgtaaggcaggtctggtgctgacaaaatctctcagtatttgcttgtctgtaaaggattttatttctccttcactatgaagcttagtttggctggatatgaaattctgggttgaaaattctttctttcagaatgttgaatattggcccccactctcttctggcttgtagagtttcttcagagagatctgctgttagtctgatgggcttccctttgtgggtaacccgacctttctctctggctgcccttaacattttttccttcatttcaaccttggtgaatctgacaattgtgtgccttcaggttgctctactcaagaaatatctttctggtgttctctgtatttcctaaacttgaatgttggcttgtcttgctaggttggggaatttctcctggataataccctgaagagtgttttctaatttggatccattctccccatcactttcaggaagaccaatcaaacatagatttggtcttttcatatagtcccatatttcttggaggctttgttcatttcttttcactcctttttctctaatcttgtcttgtcactttatttcattaatttgatcttcaattactgatatcctttcttctacttgatcgagtcagctactgaagcttgtgcatgcgtcacgaagttcttgtgctgtggttttcagctccagcaggtcatttaaggtcttctccacattgtttattctagttagccatttgtctaaccttttttcaaggtttttaacttccttgctataggttggaacatgctcctttagcttggagaagtttgttattaccaaccttctgaagcctacttctgtcaactcatcaatctcattctctatccagttttgttcctttgctgaccagtagctgtgatcctttggaggagaagaggcactctggtttttggaattttcagcttttctgctctggtttctccccatctttgtggtttcatctacctttggtctttgatgatggtgacctacagatggggttttggtgtagatgtgctttttgttgatgctgatgctattcctttctgtttgttagttttccttctaacagtcgggcccctcagctgcaggtctgttggagttagctggaggtccactccagaccctgtttgcctgggtgtcaccagcagaggatgcagaacagcaaatatttctgcctggtccttcctctggaagcttcatcccagaggggcacctgcctgtgtgaggtgtctgtcagcctctactgggaggtgtctcccagtcaggctacatgggggtcagggatctacttgaggaggcagtctgtccattctcagagctcaaatcccatgctgggagaaccactgctctcttcagagctgtcagacagggacgtttaggtctgccgaagctgtctgctgccttttgttctgatatgccctgcccacagagatggagtctacagcaaggcagtaggtcttgctgagctgtggtgggctccacccagtttgagcttcctggcctctttgtttacactgtgagcacaaaaccgcctactcaagcctcagcaatggtggatgcccctccccccgccaagcagcagcattgcaggttgatgtcatactgctgcgctagcagtgagcaaggcaccgtggggctgggacccaccgagccaggcacaggagggaatttcctggtctgccggttgtgaagactgtgggaaaagcatagtatttggacaggagtgtaccattcctccaggtacagactgtcacagcttcccttggctaggaaagggtaataccctgaccccttgcacttcctgggtgaggtgacacactgccctgcttcagctcgccctccatgggctgcacccactgtccaaccagtcccaatgagatgaaccaggtacctcagttggaaatgcagaaatcacccttcttctgtgttgatctcgctgggaactgcagaccagagctgttgctatatggccatcttggaactctgaaatggacctctttcttacaccacatacaaaaataaactcaagatggattaaagacttaaatgtaaaacctaaaactataaaaacccaggaagataacctaggaaataccattctgaatataggacttggcaaagatttcatgacaaagatgctgaaagaaattataacaaaaacaaaaattgatgaatgggttctaattaacctaaagagattcttcactgcaaaagaaactatgaattgagtaaagaaacaacctatagaatgggagaaaatgtttgcaaactatgcaaacaggtgatggcatcttagactcaacaaaatacacaagcatgtgtaaatccattttaatccacaacctgggagtagggagttaatattgtacatgcctcaatcaagaatctaccctcttggagcaattccttagtatttgaaagatcctttcagaagtcgacaacctagaactattcaaccaagagctattcaactattacactctgaatcagagagtttgttttgctagaaataattttttgttagtaaaatgaatggtttcaaggtatctgaattggctagaaatattttccaggcacctgtgctcaggcatggccagggcacaaaagtctcactagcagtctaacaccaggcctatgatgacattaagtctttggattccacagaattgctaagaattctgctgcgtgctttaactttcaaagaggctacggacagagagtggaaacttcgctgggctcccaagacaggttttctgcttccttattaaacaaagctttttggcaatgaggtgggcagaattcattctaagacttgctttctttgtcaacacttggtaataaggtgatggaggatgagaaggaaagccctcacctacctctgctcttgggaggcaatctatatctcccaaaatcactggacaagtgtgaaggccaaactgacccatctgcagctggaagcctgcccagttcctgacctccggtcaccaccgtcaccaaagtcacttctattagccacccagggtacaactgattcaagaactgtaactcaagtcatgaacctctgcaatcatgaaaacctctcttcttcgcacaaatatatgaataaaatgacattggcacaagttcagcttgtagaaattcatttaatgttgcctcaggtaattagtttatttggtctgtcaaagtgacccaaagcttatccatttggagtctctgttatgaacagacatatagtagttgctaagcaacatcatgcattgttgtttcctcatccaatttaaaattttcaattcacagtaaaggtcttcagagaaaagttattgtgcagggtgggccaaataccatttttcactgtagcccattcaatttagaaaagaaattacagcgtaccatttaatcaacataaaatgatttgtacagaacatttaacatcttcttgaaatgcagctgtcttcttttactaatcagatctacttaatttattttaaactttcccaaggagattttttctccttcaatccttgacccttcctccattccctcaactttcaagccaatttgcagatacccgttagcatgggaactgggagacgtgggaaggaagatttggaaatataagatatactcttcttatcttgtagtttagtcatgggaaaggagtctcaagtagttgagtcattctaatgagtcacttacatgaaattccaactttattataaagaagacttatttaacatagtagtttctggccaggcatgatggctcctgcctgtaatcttagcactttgggaggtcaactggaggattgcttgaacccgggagttcaagaccagcctgggcaacatagggagaccctgtctctacaaatatatttttttaattagctgggcatggtggcaggctctagtggtcccagctacttgggaggctgaggtgggaggattgccttagtccaggagatcgaagctgcagtgacctatgattgcaccacggcactccagcttgggtgacagagtgagattccatctcaaaaaaacaaacaaacaaacaaaaatagtagttttctgatatgaatgctgcaaaattaatcaattgtttgctctaataatacctggtattaccttcaagtatcttgaaaaagtgtctctgaggttccctcccaaaggatagaatgtcacattttttcatttcgccagtaatatttcttggcattaagattaactttttggcaaaactccttggcaaggaaatacgttttcacaaaatacacaaagccatttctgcatagtgaccctctcattgcatgttgagtgtattgaaacatcaagtgaatcaaaatggattaaaatacactcttgattatcacaatttcttggaatgtggaacaatctagaattgaaaccttgcaaatttaggctaatggaagaaaagaactatgaacatgaataaatggacaaaataagtggaatattttaaaggaaatataattttgttaccataacaatatggagaaaatctgattatctcagcagtaaaatagctcctaggacaagattgatttttattggcttaaaacattattaagtttcttggtttgtgtgtatatggtgggaggatattccccaggtaatatgtttaaattacaatagaagagggaaccaataagttactgggggttggggggaggtcagtttattcttgactttaggatttgttttcattatagaggctttcattttaggggacagagtatgggaacaggtagacacatgagaaaagaaactttagagaaacagtccagggatttaactgagggggtttactaaagtttgctgtaggtatggccccacactctcctccctagtgatgcagctgagcatgctgtttaaggaaccaaaaatacctgggttcaattctcagctgtgctgtcataaacctatgatcttggactaatcacatatacctttctgtacctcaacattcccatttgtaaaataggaatgaggatggtaatacctcaaaatgtagttatgcagattaatgggttaatccacaacagatccagcttcctgggcttatgatctctgcagtcccacagggcctcgtgcttagtatggtctccttcttggtttaatgctctgctgtcatcttgaaattcctaatcagtttagaacaagcaagaaaactttgacctgggccccacaaattctgtagcatgcccctagatacataaaatattcagaacaaatcctggcccatcatcagtgccagatgttgtctttattctccttctcccaccagaatttttgttttacttcccagtattcagatctaatagtgatgctaaaatttagggggtaaaaggagagcaggaggttgatagaggagccagtctgctgcacaaagtactcacttctgcagtatcccaccaatgaatgaggcaggataaaaacaggggctacccaaggggatccagaaaatctgggttattttacttgcaagtttggatagaaactacataggctggtaaaacatgcattgatggagaagtcttcatgaatcaaatttagtgagtagctaatagtatgtcagctattatttaaatcaattatttacatgtaaacaagtactttaaaagtacaagacaacatctggttccaaaatggcagcatagaaacaagctggcttcacttctccacaccccgacagaaaaccaaaaaccaaatgtatagcatcaagattatcaccaacaatattccagaactcaaatgcaaggagacagttcctggggtcacagagaagtgaataaactccaagaagacagtaagagaatcagactttcagcctcttgccgcagtttatccagcaccaaatgtgtggaataattccccacaactcagagtttctacactggaaaaagtgaaatcaaggtagaaaaccaccttccgcaccatcttgggttccctgggaggagacttgtccctgccccaacccacagaagcactggagtatctgaaaggagaaatgtccctgaggacagccagagacaaatgggggagccctgaaaactctgctctgtagataggccaaatcagaatggctgttgagcagcaccacaacgtaggggatttgttctatgagtccctcaggcaggaacccctacccaaccttcccatgctgccagaatatctgagacctcccccacctaagatgggtggaactctgattcttttctaggactgaggcaaacctgggcttaaccaccatctagtgttgaaaatgaggcagtaacatagtgggggtggtgggagagagaaaatctgcaggaaaattaaaaagaaactctaaacacatccaacaaaaaaatagtacaagccagacaaagaagattagaatgaataactattcaatccaaaggcacagatgtacatccaaaaggagcaagagaaaaagagaaccatgacttccccaaaaggacaaagcaaggtacaagtgactgaccctaacaagacaatgaaacataagctttctgaccaaaaattcaaaatagcacttttaaagaaatttggtgatctctaagataacacagaaaggcagttcagaagtctatcagagaaatttaacaatgagattaaaataattttttaaaaatcaaacaaatcttggaactgagagacacattggctgaaatgaacaatttattaaagtctctcaacagcaggattcgtcaaggaaaagaaagaatcaatgaacttaaagacaggctatttgaaaatatatagagaagaaatttaaaaaaaagaatgaaaagaaacaaagatcacctaaacatatagaacattacctcaaaagaccaaatctaaaaattattggtattcaagagcaagttgagtaggatccaaaggtagaaagtttactcaaagaaataataacaagaaactttccaaaacttgaaaaagagatacatatgaggcacagaaaggtcagagaacatcaaacagatttgacccaagtgaaactaccctaaggcatataataaacaaactctcaaaggtcaaggacatatagaagatctcaaaagcagcaagataaaaagcaaataacctaaagaaactccaatgcatctagcaacagacttcacaacagaaaccaaacaggccacaagggactcggatgacattttcaaagtgatattaaaaaaaaaaaataagaacactatcatctgagaataccatatccagcaaagctatacttcaaatatgaaggagatggaaagtcttttccagacaaacaaaagctgagagaattcactaccaccagaaccattttacaagaaacactaaagggatttctgcaattggagagaaaaaaaaaaacccactaacatgcagaaagaaaacatttgaaggtataaaacccactggtattaagtacatggacaaacccagactaatgcaatactgtaattgtggtgtgtaacccactcatattctagtatgaagacaaaaagacaaacctatcaaaaatagtgatagcaacagcaatgtgttaagagataggtaatataaaaatatgtaaattaagtcaaaatataggggtgggatggagttaaagtgtagagtttatttttctcattgtttgtttatttctattattttctttgtgatctaagtaaagttaccaactttttaaaataacttgttttatctataagatgtttttgtaagcctcatggtaaccacaatgcaaaaacctatggtatattcactaaaaatgaaaagcaatgaattaaaacatactttcggagaaaaatcacataactacaaatgaaaacagtaagaaaggaagagagaagttacaaaacaaccagaaaacaagcaataaaattgcattactaagtcttcacttatgaataataacactaaatattaatggactcaattctccaattaaaagacacaaagtggcagaatggataaagaaacaagacccaactatatgttacctacaataaacacattttacctattaagacacacaaacactgaaggggaaaggatgaaaaacatattccatgtaagtggaaacaaaaaaatagcaggagtagctatacttagataaaatagactacaaatcaaacgtaaaaagagacaaggtcattatataatgaaagacgtcagttcagtaagaggatataacaactttaaatatttctgcatccaacaccaaagcactcaagtatataaagcacatattaatatctaaagggagagagaaactgcaatacaataatagtaggggacgttaacatcccactctcagtaacgggcagatcatccacacacagaaagtgaacaaagaaatattggagttaaaccacacactaaaccaaataggcctaactgacatttacagaacattttacccacctacagcagaatacacatacttttcattagcacatgacacattcttcaaaatagaccatatcttaggccataaaacaagtctcaacaaattcaagcatgggaagatgggcggggggtgagggatgagaaattacttaaaggatgcaatgtgtaatatttgggcaatggctattctaaaagcccagaattcatcactatgcaatatacccatgtcacaaaatgacccttgtaccccctaaacctatagaaagaaaattttttgaaaaaaaatcaagaaagtagaaatcacattaagtatcttttctggggacaatggaataaaactagaaatcaataacaagaggaacattggaaactacacaaatgcatagaaacacatagaaattcaacaacatgatcatgaacaacaaataggtaaatgaagaaattaagaaggaaattttaaaatttgtatgaaacaaatgtaaatacatttgtgttgaaacaaatgcaaatggaaatacaacataccaaattctacaggatacagaaaaagtggtactaagagggaagtttatagcagtaaacacctatatcaaaaggcagacagacttcaaatggataacttaataaggtacctcaaggaacttgaaaaacaaaaagcaaaccaaatccaaaattagaaaaaaatgaaataacaagaatcggagcaaaaataaatgaaattaagactaaaaaaaatacagatcaacaaaatgaaaagttgattttttaaaagataaatgaaattaaagcttttgctagactaaaaaaaagagagaaaacccaaataaataaaatcagaaaaagatgtaacaaatgagaccacagaaatacaaagaatcattagaaactattatgaaaaactatacaccaaaaaaattgaaaaacctagaagaaatggacaaatttttgaacacatataagcaacaagatagaaccatgaagaaacagaaaacaattagactattatttactatagtcaacctgttgtgccatcaaatagtaggtcttattcattctttccaacttttttttacacatcccacctcacctcacccccattccccaactaaccttcccagcctctggcaaacatccttctactctctatgtccatgagtttaattgctttgatttttaggtcccataaataattgagaacatgtgatgtttgtctttctatgcctggcttatttcacttaacataacgatctctggttccatccatattgttgcaaatgactgaatctcattcttttttatggctgaatagtactccattgtgtatatgtaacaaattttctttattcattcatctgttgatggacacttacgttgcttccaaatcttagctattgtgaacagtcctgcaataaacataggagtgcagatgtatctttgatatactgatttcctctcctttggatataaacccagcagtgggattgctggggccatatggtagctttattttagttttttgaggaacctccaaactgttctccataatagttgtactaattaatattcccaccaacagtgtacaaggattccctttttccacatcctcatcaatatttattgtcttttgaacatgaaccattttaactgggatgagatggtatctcattgtaactttggtttgcatttctctgatgatcaatgatgttgcgcaccttttcatatgcccgttttccatttgtatgtcttattttgaaaaatgtctattcaaatcttttgcccatttttttgatcagattgttaggttttttttcttacagagttgttagagcgccatatatattctggttattaataccttgtcagaagtgggggtagtttgcaaatattttctcccattctctgggttttctcttcactttgttgattgtttattttgctgtgcagaagctttttaacttaatgtgatcccatttgtccatgtttgctttagttgcctgtgcttgtagggtattactcaaaaaatttttacccagaatggtatcctggagattttccccagtgtttttttgtagtagttttatagattgatgtcttggatttaagtttttaatccactttgatttttgtatatggcaagagatggagtctagtttcattcttctgtatgtggatatctagttttcccagaaccatttatttaagagactgtctttctccagtgtatgttcttatataacggttgtcgacaatgagttcactgcacatgtgtgcatttatttctgggttctctactctgttccattggtctctgtgtctgtgtttatgccaatgccatgctgttttggctactatagctctgtaatataatgtgaggtcagataatgtgattcttccggttttgttctttttgcttaggatagctttggtgattctgggtcttttatggttccatataaattttaaaatttttatttgtgtgaataatgtcattgatattttgatagggattgcattaaatctgtaaattgctttggggaatatggacattttaacaatattgatttttccaatccatgaacatgtaatatttttccatttttgggtattctcttcaatttctttcaaaagtattttatagtttttattacagagttttttttacttctgtggttaattcctaggtatttaattatgtttgtggctattgtaaatgagattacttttttgtttctttttcagattattcactattggcacatagaaatgctactgacttttttttgtatgttgattttgtatcctgcaactttgctgaatttgtttatcagttctaatagttttttggtggagtccttagtttcttccaaatataagattatatcacctgcaaacaaggataatttgacttcttcctttccaatttagatgccgtctatttctttctcttgtctgattgctctagctaggacttctagtactacgttgaataacactggtggaaatgggcttccttgttgtgtactagatcttagaggaaaggctttcagtttttcctcattcagtatgatactaactgtcgggttgttgtatatggcctttggttatgttgaggtatgttccttctatacccaggtttctgagtgttttttacatgaagagatgttgaattttaccaaatgctttttcagcattaattaaaatgatcatttgttttttgtcctacattctattgatataatgtatcatgttgatttatttccatatgttgaaccatccttgcatcccaggaacaaatcctacttggtcatgatgaatgatctttttaatgtgttgttgaatttggtttgctagcattttgttgaggatttctgcatcaaaatttattagagatattgacctgtacttttcttttcttgatttgtcttgtttgagcatcagggtaatactggccttgtagaattagtttgaaagtattccctccgcctctattttttggaatactttgagcaggattggtattagttctttaaatgtttggtagaattaagcagggaagccctggggtcctgggcttttctttactgggagacattttattctgactgcagtctcatgacttgttattgaactgttcaggttttggatttcttcctggttcaatcttggtagattgtatatatctaggaatttgtccatttcttctagattttcaaatttattggcatatagctgctcatagtagccactaatgatcctttgaatttctctggtatcagtcataatgtctcctttttcatctctgatttatttcaatcttttttcttagtccagctaaaagtttgtcaattttaacttttcaaaaatccaactttttgtttcactgatgttttgtattgtttccttcattttaaattaattttatttctgctctgatctttattatttcttctactaattttgggtttcgtttcctcttgcttttctagttcttccagatgcatccttaggttatctatctgaagtttttcttcttttttgatgtaggcacttatactatgaactttcctgttagtaccacttttgccatatccacatgttctgttagtcgttggatgaaatgttctgtaaatattaattagatccatttgatctataatgcagagtaagtctgatgtttccttattgattttctgtctggaagatttgtcaaatgctgaaactggggtgttacagtctccagctgttattgcattgggggtcatctctttctttatctctaataatattttctttaaatatctgggttctcccatgttaggtgcatatatgtttaaaattgttatatcctcttgttgagttgaccgctttatcatcctatagtgaccctctttgtctcttcttatggttttttgtcttgaaacttattttttctgatacaagtataggtactcctgctttttgatttccattgacattgaatatctttctatccctttatttttagtctgtctttatacatgaagtgcatttcttgtagacaacaaatcaaatgggcttgttttatccatttggcctttgtatgtctttttggttggagagattagttcatttacattcagtgttattattgataagtaaggagttactcttgttattttgttatttgttttctggttgttttgtggtcttctcttccttttttttcctccatcttccttttagtgaaggtgattttctctgatggtatgatttagtttcttgctttttattttttgtgtatccattgtattttttttttttttttttggtttgtgattaccatgaggcttgcaaattctatctaaaaacccattgttttaagctgataacaacactgttggcataaacaaaaagaaaaccaataaaagctctacaccttaattttcttcccctgctttttaattttctgttgtttctatttatatcttattgtactgtctgtcttgaaaagttgtagttatttttggttggttcatcatttagtctttctacttgggataagagtagtttacacaacacagttacagtgttataatattctgtgtctttctgtgtatttactattagcagtgagttgtgtgccttcattcggtgattacttactgctcattaacatccttttcttgccgactgaagtactccctttagcacttcttgtaggacagatgaaacccctcagcttttgcatggaaaagtatttctttctccttcatgtttgaaggatattttcactggacatactattctagggtaaaaggttttttccttcttcagcactttaaatacttcatgtcactctctcctggcctgtaaaaagtcagatgctggaagtactggacctccactgtatgctatttctttctttttttaatgctgcttttaggatcgtttctttatccttgacctttgagaatttgattattaaatgccttgaggtagtcttctttgggttaagtctgcttagtgttctatgacaccaaaccttaggtatctaggtttgggaagttctctgttattattattttttaatacactttctacccctatctctttctctactccttctttaggaccaataactcttagatttgcccttttgaagctattttctagatcctgtaggtgtgctttatatttttttccttttgtctcttctgtgtattttcaaatagttcactatttgcaaataatagaattagtctttaagctcactgattctttcttctgcttagtcaattctgctattaaaggactctgatatattcttcaacatgtcaactgcatttttcagctccagaatttctgcttgattctttttaattatttcaatctctttggtaaatgtatctgataatttctaaatttcttctgttatcttgaatttgagtttcctcaaaacagctattttgaattctctgtctgaaaggtcacatatctttgtttctccaggattgttccctggtgatttatttagtttatttggtgaggtcatgtttttctgggttgccttgatacttgatgttcatctgtgtctgggcattaaagagttaggtattaattgtaatcgtcacagtctgggcttgttttcacctgtcattcttggtaagacttttcagatagtctaaaggacttgggtgttatgatctaagctatatctgctttagggggtacctcaagcccagtaacactgtggttcttgcagacccattgaggtaccaccttgatggtcttgaacaagatccggtagaatctgcctggattaccaggcaaagacttgttcttttctcttagtttctcccaaacaaacagaggctttctctctgttctgagccacgtgaagcttggcatagagtgacactagcacccctgtggccaccaccattaggactgcactgagttttgcccaagacctgtaaccactccctggctactgcctaggttctgccaaggccctggggctctgcaatcagcaggtgccaaagtcacccaggcctgtgtccttcttttcaggatggcaagttcccctcaagctccagacaggtccagaggggctatccaggagccagggaccagagtcaaaaaccttagaaatctatcaagcgttctattgtgctgcagctgagctggcactcaaaccacaagatgcagtccttcctactctttcctcctctttccaaaagcagaggagccttgccccactgtggtggccattgccacccctggcaacaaggagtactgccagactactgccaatgttcccataaggccccaaggctctttagtcagcccgtggtgaatgctgcctagcctgggactcacctttcagggcactgggcttccctctgacccagagcaggtccagaaatgccatccaatagtcaagtcctagaatcagggagtccaagagcctgcttgctgctctaagcacctgtggctgagctggtacctaaggtgcaagacaaagtcccctttacttttccctctgcttttctcaagcagaaggagtcttgccctatagctcccccaactggtaatgtactgagtctcacctgaagccagcaagtccaaggctcacccaaggccctcaacatagtacctgggtatggctgttggttatccagggcccaaaggctcttcagttagcaggtgatgaatactgcaaggactgagttcttctcttcaaggcagtgggttccctcctggcccagagtgtgtctagaaatgttgtccagtagctagggcctggaaaaggggcctcatgactctgcctggtaccctattctgctctagctgagctggtatccaagatgcaagacaaagtcctccccactcttccctctcctcccctcaagcaaaatgaaggggtctcttttcgagtgggtgagctgtgcagccagcagttaggggaggggtgatgccagcacttccttagccaccccagctgttgtctcagtagcttatgtgtccccccaggccactggctctgggcccaggactcacctagaagttgcagtccctgtggcctacactgcctttcaagcttatctggggccccagagtattttagctcatggtggtgtggcttgcaagaacccaagttctgactgctgggatcagtgattcctctgtggctagggctggtttaaatgttccatcagtgggcagatgtcagctgagtttgttccggttttcctctttgctgtaacaggacagcactaagtccaatgcctcacaattgctgcaccctccctcccccagtgcacagaaatgctttccacacctcacctcactgctagatggtgggggatgggggatgtcagcaattcaagactgttttttctgtctcttcagtgcctctttcagcaatatgaagttaaaacaaggtactgtgagtgcttacctgatttttggttcttatgaggtttttttttttgtgcgtagatagttgttaaattgttgtccttgtgggagggaatgatccatggagtcttctattctgctatattattccacccctctccccactaagtattctgaatatcaggtgtatcctatcattcacagggaaagagaaccatggaggcccacgtgcttttatgtctaaataggtacacgttattcatgaatcaggcaaactcctaaataatcttttcttatactactttggcaaatatagcttcaaatgactcagaaggccaaacttcaagtttaaggattctttaagctctcaaaattgctcatgtgccagcctatgtatgaccactcccgcctctcatccaagcttcaatcactgcttctatctataaacagccaaacttgagccaccctcagggctgggggacacatgcaccagaggtacaggtaccctctacaggacaaatctgagaaagacatctatacagggcttggaagaaaatctgtgtggacagggaataccagggccttggatacctagaatgagatcaagaaagtcaggtagggggtaaaggtgagaaccgcctttttgttcacagactgctcacctggtgcagaggagcatggttggaatggggttacaacaggggctctctaagtataggatgaacatcatccctgaaatcttggttaccctttgagtctgtattctgaagggtcaacttaaattaaattttgcttcatctacatattactatacagttataaattccaaattatagttggctttgtgtatacaggcatctaaattttctagactcaaatttatacccccaactgtgctcccaattaccccctccaactcctacccagccatcctccaattctttccaaatattcccagccagcaatcttcaatgccactcctaacatgctcgacagcactgtctccctcaaacccctcagtaaacatttcagatgagctgttcatttactctcttttcagtgatgagatcatggcacattttccaggaacaaatgggttaatttatattgctgtactactacctaaaatgaaaatattagaaacctatctattataaatatgaaggtcacgacaaaaaagagagagagggatgtcatcatagcaaatggagctcatgagtattctaaatatagccttagtcaggacttgtactaagagtctagggaccttttagaaaatcatttttctcgtgttgctgccctttgtatctgacaaatattgatttcagttatgttttgaataacaatgaaaacagtgccttagatagaactttagtcataaactatttaacaccttagaaagttgaaagaactctggacttacagttctgaggctgggtagtatctttttagcagctggatgtacctcaggcaagctcctcaatctctctttcctacattgtaaagagtcatagaattttggagtggaagacacctttcagataatcgagtctaataagccaattttacacttgagaaaactgaggcttgaagttattacataacagtctaacgtcacataggtcattggagaaaggttgcaagtttccactaaaaatggtttggatgcagtcactgatggggctcttttagtctaaaagtcattgctttttaatatcagatcatttcagtaacatttctcaattagcacaagcatagttctcactaaatacactctttctgttaaaaaaattgttctgtaaaaaaatcagttttttttcattaattaggaaatcaagagaataatagaaagaactaagagataaaccaaggagggagcctgaagaattgagttctgggtcctgttctagaacattccatcatggactttggataggtattgtcaactgacctcagtaatttgtcattgtacttgaatgggaccagcaatgacaaaagtccttgagaggctgagacgaagacaataaaaatcttcccttggaaagaatcctagcatttttgtcagaaggaacaaaatagaatgaggtgggtgtatattttgatgaaaaataatctgatcaatcatacacagaaggaccataaacatgtgacactatcttagtacacatttccaggacacacacaccaaaggagaatgcccgtaaccggtgtgctgacattttaaagtaggaaaacagctttaattaacactctttgctaagcccttctaaaaagccaacctttccaaaataaatctttagtaatacactgttaatagtttttagaatttctgagtgttaaaatttcaaaagtgtttataaggagaggtatggccatcaggtactatctggagaatatatttaattaagaatggctaataatattaaggccatgactgagctgtctgtaacaccaggtatcagggtgaaaactgatccttgttatgttagcatgaaatgtaggtaatagagcaagaaatgtctataatcgggactgttagccacagagcccaaaatggtcatggttaactggcctgtctcgagcgcggtctttctgccggaagcactcagcatcctgcctttagcctggccctggctgacacactcctcctcatccccgtgggcccactgaaagcctgcccttgctgggcaacctgccaggactgcatccttctattgactccttctcacactggcctgtagtggcccgtttgcttgtgtgcatttcccatttgactgaggtaggccctcctacggcaagggctgtgtcttgtttaccattttatccccagggtgcagcagaggactccatatagcaagaggtcaagaaacatttgttggatgagtacatggtatgatgaccatcctggttgtaagaatgaggatgcattcccctcttttttcctatgaaaggaatagaccctcactttagctagtttattcaagagtttttataaggagaaggttccacaggattcttcagaaatgacagcttgtaactagaaaatgaccaagaactgggagagctttgtcttcctctcttctttatccccctttctccccttgcatgctccattctcctgctcctcaccacagagcagctttcttattcttgtcatcacagtacacctggctgcctcaagctcaattccacatgaccttcagttctgttgcttaaaagcactgatgtaaagcacgcagatgtcccaagtccaccaggcttaaaatccaatgtactcactgcagaaggtaggtaaaagcctaccacagtgaaacatttctttgtgtcttcccatcaagggggaaccagccaaaaccctttgcctcacatttgcctccagtcgccttctagaccaagatggcaagcaccaagactcggttccttctctcacctcagccctgaccccacctgcaaagagccacagccatatctgtgcctctgttccatgcatcctctccgcaccctcacagaagagaaggatacaacactatggcattatttggatgttgcctgatagggcaaaaagaagccatcaaggatgaggaatattttggtggtcaggccactagtctctgatgctgtgacatgtgtccagaaagtggtactaataggagactcagtctccttattcaagctttctgatttgtggtgttaagaaccagaatcctggaaccacccactagcttccctctgcaaatggccatcatggcccaagaataagtcaaacctggaaggattgtgagtctcatttcttgcattttgaggctacaatgtctgaaaggtcctcaggcttagggaccatgactactcaccactgcaaggagctattatgatggccactctacaacacctagagactcctactagcaggttttgaaacccatagtccaatgacagcctctgtgtcattcaattacatttatgagaaaaaaaaaaaaaggctacctaggtacaacttctgcggaggtaaacttccagagaaggtagcatgggcttattgatactccaaacatgtctgtcaaacatgtacttacatatctaaaagtagatagttccctgggcaagaagatcctctggcagaccactgacattgtgaaaggtagtacttagggaaagttaccctaaacacaggcacccagggagagttcactaaacactaactagtactgaaatgttcagttcactgaggttctctacactagttcctggtagaagtaactaaccattaccagtatctcattcatctctcattttggctaatggaagactgcacaactcggccctttgcatttgggaactggagggccatcagactattttctggccaatggattgatctgaggtagcaaatagctccagtctctcttcccctgctgtggccacctagaggtccatgtgttccaggtggtgcaatcaaacgatggtgaagacaccatcaacctgggccacagatgactgtctaggcactatcattcacccgtccttgaatatgcagtatattgagaataaactcttatgttaagccattgagatgttggggttattttttagtgcatgaaaccaagcctgttcccattaaaacactcaatcatctcaattaagttccaggtgaatcaagcccagtccttaagccaacaaaaaaggtttgcaggtctttgacctttgagccacctttcagaattaagaggacttctggttcttccagaattgggaaagagagagtaccatgaaccataagattatgaaacataattctataggagctgaatatacaacagcacttgagactctgccaattaatttaggactggagaaaccaaccatgactaatcaacccagagcatgccagaccacagccacgaatgctcataagaacgatcttcacattcagatcagtgggccatgcaactcaataatttctttcagacaatgacacaaaattgcctccccacttttctgccttaaactgaacactgctctgacctaatttcctacaattttgtttccagtcacttttttaccctcaaacaaccttataattgcgataatgaggcacattagagcccacagaagtttttaaggggaaattagatcagttcagggtattgccctcccaaattaaggtaattatcttgaaattcaaatgccacaaccagaattcagagcatcctactcacacccatgtcactcctcatcatatccactgtgttgtcattaataattgtcattccagaaacaagcatgccatcagccaaggcaggggaaatcacagtgttctctttaattcaactccacacaaacatggcagcccagaaaccttaggatccagcaagcatcttggtctcacttgaccctagggactgcactaaacactttccgtgaaacactctactgccttttcctagcaataggactgactcgtggtcctcctcctaccactgtgaccactccttcttggtctccttaacggagacctccccttacctccccttagttattgacattccccaagggcccattctcagtccattgcttttcctgtgctctcctcgaataatcttacctactctcatctaccaaatacaatgatgcccaaactcccctcctgagatctcaactcatataccttctgcacctctccacccagatattccacagacacttcagaactacatgcttgaaataaactcatcactctctcccaacctctttcctcattggtgttctctattctgttcagatgacgtactggtggaatgtgtacctccaaaagacatgtccacacggaaactcagaatgtaaacttacttgaaataagcgtctttacagatgtaattaagtttaggatctcaagataagattatcctaaagttggggtgggccctaatctaatgactgatgccctttgaagaggaagacagaggaaaatttgagacatacaaaggagacggtcacatgaaaacagaggcagaaattggaggggtgcatctacaaaccaagcacaccaaggatttctggagccacgagaagtggagcaagaaagaggcattggttcatgaacacaaaaatacagttagatagaaggaataagataagatctagtgttctgtagcacaacagagtgactagagttaacaataatttattgtatatttcaaaataactagaaggatggaattggaatgttcccaacatgaataaatgataaatgcttgagatgacaaatatcccaataagcctggttttatcattacatattgtatgcttctatcaaaatttcacatgtaccccataaatatgtataacttacgtatccataaaaattaaaaatatagaaaaaagttttttaaagaaggggaacaggacagagatatggagtggattctccctcagagccaccacaaggaaccaatcctgcggataattttgttttttggacttctagcctctggaactgtgagacaataaatttctgttgtgttacgcccccaggtcatggtaattagttaccgtagcacagggaccctaacacagatgcctgcctccagccatctaaaacctggcagacaccttcctctcactcccttcccattcccaagcaatcgccaaaccttgctggcttttcctccaacacattgcccacacctgccctcctatcccacaagtctccaccatcctattgaaatcctcaccatccttgcctggagtcccatcagagcctctgccctgatctcctaggcctcgatctctctctctcaagtccagcctttacacagacatcagaaataccttcttaaacagaaagaagagagccctaaagtagtgcttacagcccttccctgcctggccccatgcactcctccagcctcatctcattccactactcgttcccatgaccccctggacagcacctcaaactcctccagtacctgaattcctgaggttgtttctcacctccttgcatttgctcaggctttccctcagatcgggatcacctgtctttaccccaaaccctctacatcctttttacctaaatagctcctcagtactcatttttaatattccagcaggtatcacctcccctaacaatcatcctcccctggctgggacccaaacacatccaagagtgttggccataatacttaccatttaggcaccaatcgagcactgctaatgctggccacaacactgggccagggtcctgaggcaaccttatcccctgcggcctcaccaggtttaaccctatcattactgattctggtggtggagcaactggagcagccataccaatgcatgctctccaaatatcagctgtctccatttataatgttatatctaccaaattgcattataattacttctgtgtctatcaccccagtaggctagaaactcctctagggcaagtgtggaggtcttaattcatctttgtatccctaacagccagtaagcacaatatctgtcaaaagtagatgttctatgaggcttagctaggtgcacaaatctgagtgaattgatgagtgaatgaacacatgagtgcacagaatataacaagaaactattagctcccattaaattagaatagaggagtgtgagttgtagcagaaagattttgtgttgattcgaggaaacgttctggcaacataggacatgccctgaaactcatgcagctgagtgctcccaaatggagggttcattcctgaggtcctaactgagttgctgacctctgcccagctggttccgaggagcatagaggcagtgcactccccaagaaggaagcatcaggtgacctattagcgggagcagaagtacagcgctcacagccttgcatcctggattgggcagtgatccaggcatgagggcaggaggaggatggttaacacaatcggggttttgccaagcttggctgcttggcagtggaggctcattttttacctttgtgggtagcacatcaactatgacccatgtttggatgcttataacttgtcctccttccctaatatgtcataaaaagaaactcctggggaattttaaggagtgagaaaatgccgaggtcccatctagaggcactagatgatcccctgagactgtcatgaggcctaaattgtccatgaaagtttagccacaattacaggatttagcaaatttcatctacacatatttgcataataatacttgcaattacctagtaaaagagatacgctaaatgcctcagaatggaagcttggagctcagtgaacagtagaacaaggcatacctgaccaggtggcaacatggagatgaggttatctgtgagactaaggaggaggtactggggccagctgaccacctagcacgtcacagggtgacatggcctacatgaaaacctactttaaaacaaccttgatataaactatgtgatgtggttgtacaaaggtataatctcaatacggttgcacaaacttatattctaacctgtactccagcggtgcttaattagcatttaaatgctcctatcaaaaacaacactagagaggttagtgaccagaatgagaagctgctaagaatttttttattgtgtaatatacataacacaaaatttaccatgttaactagtaaatgtacaattcagtggcattaaatacactcatattgttaggaaaacatcaccataatccattatccagaacatttttcttcttgcaaaactgaaactttgtatccattaaacaataacttcccatcaccctgtctccccagcccccagcaaccaccactctactctctgcttctatgaatttgacgactctaggtacctcatgtaagtggagtcacacagcatttgacctttgtgactggcttacttcacttaacacattttgaaagttcatccatgctgtagcacgtgtcaggatctcgtttctttttaaaggctgagtaatattccattctatagacagaccccattttgtttatccattcctccatcaatggacatttgtgtcacgtccgccttttggccattgtgaatgatgttgctatggacatgggtgtgcaaatatctgttcaagttccagattttgagtcttttgtattttgtttctgtttgttggttggtaaaatcaatgacatttgagactgatggttggtggggcacatgcatagcgctccctgcctgtgcagaaatggtccgtagaaaccaggcagggccagcagcctgtgccagaagagcagagccctggcctggaggtccatagacccaggtccctgagctgagctggccataggacaccacaggcccccagccagagccttacttgcaagtcaaggcctgcagcctgaggacaggaagagggcgacacccgtctcccttcttggttacctcctgcaaaccacaagggcctacctctatttacccagattggctcaggctagcccatgacacagagagagcaccatatcagtacaccatgggttaaatgagatggtaaatgaagtgagtacacacacagcccctagaacattccaggaacttagttaagtgctcaccaaatccaagctatgatgtgccagcatagcagtaaggcaaaggtgtgatccaggcagggatcaatgtcacagttagggatgggagtcagaagatgccaggtcaggggcaggaggacagacaggacaagtgtacaggtttcctatggctgctgtaacaaatgatcatgaacttactggcttaaaacaaatttattctcttacaattctgaagatcatgattctgtaatgggtctcacttggctaaaatcaaggtgtccgctgggctgcattccttcctggaggctctgagaggagaacttgttcttccccttttccagaggctgcctgcattccttggctcatggctcctcttccatcttcaaagccagcaaccaaccaggtctttctcacattgtgtcactctggtttcctcttatacctttctcttctacttgttatcacacagtcctgcctcaagatgggtttgggcaagaacataattgccccaagtccctgacataaacgggtgtagtatgcgcatataacctgcatcctccacattgtcatcaatagtgacagaacccttgggataacactgggcccacccagataatccaggctaatctccccatctactggtatgaaaccttaattccatctgcaacctccattcccctttctcatgtaacctaacatattaatatgtaccggttccagggattaggatgtgtacatctggggtgggggtcttattctgccttcacaagtgatctggcaaaggcaatactgggagatccccgggagagagtctgaatcaggcagcagaactccaagtaccagggagaagtataagaatctagcctggccttccaagagcaaagcagagtgtgaggtctgagttaacggggcattatcatagcaaaaacagtggcctaggaagccaaacaggggcccagctggtgagactggggtacaagtggaaacttagtcttgagaacaaggtagaaggacatttacagtagcaagggcaggataagagcagcatttccagcaaggctgatggaatgtgtggttgtctaagaatgtaatcaattattagagcagcctcaaattgtcctgactttgaagcaaggccgatcacatcttaaagttagaaggcaagagtttgtgggaaacagcacattctggttatgagccccatgttcaagggcagaaggctgttggggtatcaaacccaaccaacaggacaaggggaggacaagtacgatggaggacacaaactcagtgaaacaaggagatgaaccaatacacacagggcatgctgaggggtgaaaagccaacggcagccactcagctacccagctcgagctttgctgcagaagcatgcaagctgccagtcaaaacccacccagacagcagaggaggactgtagaggggtcctgggagagaaagcaaagaacaacgtggacaagagttatccaatgtgaatttaattccatttctgctgtgcagccagtgatgtgaatttctttgccatctcttcagaaaatctaaggccaagtatccccttctcattaatgcaaggtcccatcagatctgcttggtggatgcttggaaacacccagtcctgcttcaagatgggctggggctcgaggacataattgccccacagtctcttatgtcaccaaagggagacaacttacagacacaacttgcagttgttcctcagtatctgcaggggagtggttccaggacccccagagataccaaaatctgcagatgctcaagtccctgacataaaatggggtagtattttcatataaccttcatccacctatgtactttaaaccatctctaaattgcttataatacccaattttatggtagatgcacctgacagcaataacttgacttgagcatatcctgagaatgactgtgtatggcagatgcacctgagcatgtgttcagcattctgagctaaggattccgggagtgaacaacccagagatcaattccttatctatgaggagcatctgagcccctgacccgacccatagtattatatataagctgcatgtgttctgtaagtggttgtggttctcctgcccagcccgccaccactggactctctccctgtgtataagcccccctataaaaacccatgactcatttgctgcctctgagtctcttcttcagactcttgaacctagtgctatccccactgcagtcaataaaggttcagcacaacaccaatacgatgtaaatgctatgtaaatagttgttatactgtattgtttttgttaggttcaagttcagttccagcccatgttgaggtctgaagggagtgggtggatgagtggcaaacagttcaaagagcactgggttgggggcgtaggtaggtgaaatatggctttattcagcagctttctcatcagcagctctcttacactgtccactctgtatcagctgcttgagctggctgctcccacacacagctgcgcagccggctctcccttaccttcagggtcagcagcttaactctctctgggcacaagtgcacctgtacagtgtcagcagcgcaattataccttttacagacaataatggcttagagccaagtgatggtcttccaacattatggctacatagctgtgataacaagtggagttagacgcctgtgttctaaactcgctgagttatgcaggatatttacctcagcccatgcccacttggccgcagggcagccatgttccttacagcttttaatttgtattttgtattgttgtattatttaacatcttcaatccatgattggttgaatttgtggatgcagaatctgcagatacagaggaccaactatacaagaaagtcaaataagcatagagtatgaaaagggacctctctcccctttttattctccttttgggcttagattctgtttttttcttaagggaccttcagcactgttttgtttaagctgccgaaagccctgtggtcctgtgttgtaattagttttagccatcagcagaaagcacctttgtttcatatctccaaagtcaaaaccaatcaatacaccctacactttattcctcccctggtcaatcagaaggtcaactggaaagaaactctccaccctggggatgatggaccctaggaccacaaagaaagctaaacgcatgctgccttcttccactttcccctgagaagctgtcagaggtgaacgaaagggcactgccgaggatggtaataatgaatgttacaagtgaacctcaaaaagcgggtgctaggacccagatgaagctccaacacatgtttccgcattggtggcttttcacagcctggggcctcactattaaaaatgaatatattaattggatcacagccagcccttttaactaaaagtttccgatttgcaatttaataaactgctgccacagtgactagttaatgaaaactagagcattaagacccccctcaaacacctccttgccagccttatagagctggttatcaacagcacccattttaaacaccgagcctcatttcagaaagcctcaagatcacgtatggtttgccatgcaagaattactactacaaaatgattttaagtctgcttataaggtacaacgctgcttaaatccaaaatggaacactgtttttagattactccttctggagaacagtcacatcccccaggtatttaccatcaaataaaatgatggccaagcacacggtgacctgagagcagagacagtcattgggtggctgtcagggagcttgggaagaaactacttctgccatttttgtgcaatcccaaggaaaggaaaagaatgttcggtaagagaagcagaaggaggtcgtgccttggcattaacttcagtgaatcaagcataggctgtagtctcagttcagttgccactcacctctaggctggaggagaaaacatcaaggtccaaaattaatggaagccagaggccttcccaagcaagtcctaaagttgtgaagctgattggtggaagacgagtgcccgtggggccactgtcccatagtacctgggtggcactggattcatcctcaacttcaccccagagatggggctagacaagcaaggcagatacagctccacaaagagtgagctcagaactcaactggatttaggtctacagactcagcccgcaggaatctgtgcaacacttttcaggtgactgattaaggtaaggctgattccacttaacagtactgatgagtattgccttccactgtgtcaaaataccctccacctgactttcaaggctctgcgtgatctggcctaggctctgcgtgatctggcctaggcctacctggccagctttatttctcataagcaccgatcttcccactgtcctgcagatttcctgtctttttcctgctctccttttccagaggcccatccctcatggtccatgagataaaaccatcacatattctctgagcctgagattctgagttgtcagaccccagggcgccacaggaatgccagcctgaggcctggggaagctgcatttttacaaggccgtcatcaggagacatagctcgaggtccagatccagacccctcctctacgtagctccctcattatccacccagggtttcccaagctgcaggatgtggccccctagtgacatcaactgggggacttgagagggaggtgagcatctctaatgaattgcaatcggattggaagtgtcaggaattcgtgcagaatccctcagaaatatattttcctcagagtgatctccctgttggtgcacagtcacctactcacaagataacggtgtgacaggtaggccccaaggtgggttgttgctacaagaaattggaaaatgatgatctcaacccataggctccacctgtttttagtctcacactccatgtttaaaatgtttgaaaataaactctcaatatatgttatcaactatagtataccaattatatgtattaactatatatatgtgtactactctataagatgtaccttataaacatgcccaaaagtagaaattaaaggttacatagaaaaataaatagaacataacttccaatgtttgctatgtccatgccagaacctgccctttggagatgatgactctggccctcaccactccctcacttctctgagttcctccttttctccaccatcacaaaattcagcatttagaatatatgatccctgcccacaagtttctcaaaatctggtaaagtgtcaggtgcagtggctcacacctgtaatcctagtactttaagaggctgaggcggccagattgcttgagcccaggaattcaggaccagcctgggaaacatgatggaaccccatctctacaaaaagtacaaaaattaaccaggcatggtggtatgcacctgtggtcccagctactcgggaggctgaggtgtgaggatcacttgagcccaggaggtttcaactgagaccgagatcacgccactgcactccagcctgggtgacagtgtgagaccctgtctcaaaaaaaaaaaaaaaaaaaaatctggtgaggaaactgatatacaaatatgtcaatataatacaagacagaaagtgccaggatgcaaatgtgaacaaaatgttgtggcattacagaagaggcagctctcggtcttcccgagagacgcaaggaagacttcatcgagatggtgatgagtgagctggatcttgaaggctggatgggtggtgccaggctgcagaggaggtgggctctccagagaaagagagcccgtcgtgttcagctgttcctgcccttcagaatcacgtgggcacttaaaaaaaaatactctgaactcctcctctcagaatctgactcaggaggtctgcacagggagggcccagcatttgcataacactcccatccccttccttcctcacccctgcagcaagacagcaagaagtcatggaggggcttccagtggggctgcaacagtagctaaaacttgatttaaaactcaaagcttctcagtgtgtgggagtagcataaacatagaagcaagcaggtcactaatgcagagcaattttttcttaaattgatacagttcagcctcgaaccatatattagtcagctcagaatactataaaaaaatacaactcagtggcctaaagaatagacatttatttttcacagctctagaagcagggaagttcagaatcaaggtttagttcctggtgagggctctcttcctggcttacaggtagccaccttcttactgtgacctcacatggcagagagagagtgctcatgacttcatctaaacctaattacctctcaaaggtctccatcacattgggagttggagttttaaagtataaatttacagggctggagagaaggcacaaacattcagtccataacacgccacttacactgaagtggcaaaaggcttaatacccccaaatgctggttgcctgtacatcctttgtagaaaacgttgttaatcatttctccagctaccagccattcctcttcattcctttttttggtaaacttctcatactttctggagttctcaccttggctccaaaagtaatgactgtagctcctaagtgattaatttagggatagaaatcccctcaggaaatccaaaccaaggagagacagagactctggagactttggctgggactgctaatggagagactaggatcttgtgttatattgacatatttcccttcccattcctacctgaatgatgagctggataatggtagacaacctatggcagtcatcttgctgttatggggtggggaaggggcatttctgagaaataattcatataggaagtagagctaataactgaaaaagaaacaaccagggcatggtaacaatgccagagtcctggagtctggttcaccttttccattatgtaaatgaaaatttttctacttttctttaggccagttggagtggcattttctattacttacaaatgcaagggtactaatgatacatcttccatgccccagacatactatgagctaattggaaactcctaactcctgtaacttctatgagcatggtaggaaattggcaattttttttttttttttttttttttgagatggagtctcgctctgtctcccaggctggagtgcagtggcgtgatcgcggctcactgcaagctccgcctcccgggttcacgccattctcctgcctcagcctcccgagtagccaggactacaggcgcccaccaccacgcccagctaattttttgtatttttagtagagacggggtttcaccgtgttagccaggatggtctcgatctcctgacctcgtgatccacccaccttggcatcccaaagtgctgagattacaggtgtgagctaccgcacccggccagaaattggtaatttttactgattaggtgaacaaacaattcttttccaaagcagaaacattcaagttacaatggaaaattttatctttccaaagaacaattttagacacaattatcattgtttacatgatcatatgtttaaataaagtcactttctttagcatttagaaaagaaaccataaaatgtaaatggccaaaacgtatttgatctatatacacagtatacgtaataaactgcagttacaagaggttcctctgatcttcactaatccgattctataattttctaagattcccttccaaaacccaaatgtaaaattaagattaaggggtcattacaattaagttcagttaaacatgcatccattcaacagtatgtcaaccaatagggacaatgtgcttttaagtaccaaaccccataccaagcattagattcatggaccagatatagatgtcttataaactatgatgaaactagacttgataagcaaaggagaagaacgaattataccacattgttccaggcattttgtagaaaggaattccatcctatctgcaaaattagccttcaagccctctaaaatcccttccaacctaaattttaattactattttcaatgtttctacttcctattttgtaagttctataaaactgggaaaaaatataataaaaaagattaaaagatagtaattcctgggttgtctaggggcaaacatactgtattaggattctttggttgtaattgacagaaattcaattagaatagtttgggcaaaagaaggaaagcccattggctcacattaaacacactgtccttgctaaaggtggggagaaactagagactcaaatgttttgggaactctgtttccaccttgttctcagcaagtacactctattatttcagagtagccaagtcctgaggtcagacgcagagctgccagcttccctaaacttaatttgtcacagttttttgaccagaagaagaaagactccatttccagtctacatctcccaggaagaactctgattggccagtttaggttcaatggagggcgaccaaacatcccactttgcctgagactgaggaggttcctgagacatgggactttcaattttggaactggaaaagtccacgcaaatcagaacaagtttaaccctagttaaaagccaccttctaaccaattaccgtggctagccgttgccagggagttggaatttacagggcccattcagacctcacagtgggatgaggaaaaagaacgacttccatcataaaggaatgggttagacatgatcactaaaatgtgattactctcagtcaggcagctgctccaatttgtttctatcatatatatctaaaaatttggcaagtgattcctgaaaccattccaatcaaataaacttgtcatggaattttaatttcttaaactcaccgcaatgaatcatttccattactgcttcaatgtaataaacactaccctaatgaaccaaaagagttaatacacagcttaaatcacctccatatctaagaagcccaactcatttcttagaaactatcccactaagtactacattaatcatttgtcatgtcttcaaaactactatactctgtcaaaacacatcttatagtttgatgttaacagtctgaagcatttgtaacaatataacacatgcatactgtcaaattgcatatttcaccttctggcaattttcttctcttgagaacttagtttctcctccatgtgctttagaattgcttgaattctttagctcattctttcaggaaatagaattaatatttaaaggcagtaacagtgtaatttcaagaatgtcttagtaataagcagagttctcataacataaattaccctatcctttcaatagtcttattcccttttccaagtcacacaatcaagataagctgggaaaggggaatttcaattatattaaatctcccaggaacacttaggtttgctgaaccagaatgcaaagtcaacaaatacagagacacatggacatatctcagttgcagtaggtttcctgtgcttttaagaaaatagattcagtaccaagtgagcaaagtagtatagtgtaagaaaatatcctggatcatgaaggcacaaaaagtcataactgcctacagctctcccactctcagaatttctgctgaccacttttgttccagttgtacaaactgttagtcactctggggaccacttattgtctccaggaacacactgatgtctctagcatgaaggatctttttctcctttgattcaacagattcaagtttcatatttatccaaagaacatttactagaaaaataaaggcaaataagcagtagaatatacaaaaggacagatatggatatatttacagagtaaaggtactttgttctgaggttgctgaaataagacaggtcttggctgggcatggttgctcatgccattaatcccagcactttggaaaactgaggcagaaggatcacttgaggccaggaatttgagatcagcctgagcaacatagagagactccatctctacacaaaattttttttaaaaattagccaggcatggtggtgcacacctatagttccagctacctgtaggctgaggtaggagattgcttgagcccaggagttcaaggctgcagtaagccatgatcatgccacttcactccagcttgggtgacagagtgaaaccctgtctctttaaacaaaaagaaagaaagaagaaagaaaagaaaaaagaaagaaaagaaaagaaagaaggaaagaacagaaaagaaaggagagaaaagaaaaaaggaaaagaaaagaaaaggtcttatctccttctgggaaaaatcaggacccccttgtcctcagctctagaggacttagatgacacactactcacaaccctagtaggagacacaaggctcacatattccctaacccccatttcatctcacacccaaccttttcacaaaaatcaaacaagactaggtatactagaagctggaagagagaatgggggaagtacatcattgagaatggacagaaagacctaaaaagaaacagaaagtcctagaaaagaaggaaagaggagataacaggttatgcatcagcattaagaaaaaaagtagcaccagcctcaagtctagagagcaatcaagacatcctgatgagcacagtgagcctgggggatggaaggagcccccacatttgggcataggcagagtccccactgagtctgaggagggtcagtggtcctaccattctagggtctggaggatggtgaccctcttctcacagctccactaggcagtgtcccagtggggactctgtgtgggggctccaaccccacatttcccccctgcattgccctaatagagggtctctgtgagggctccacctctgcagcaggcttctgtctggacatcccgacttttccatacatcctctgaaatttaggtggaggctcccaagcctcagctcttgcactctgtaaacccacaggcttaccatcatatggaagccacaagccaccaaggcttatggctttcaccctctgaagtagcagcctgagctgtacctgggcctcttttagccaggactggagcaggagtagttgggaagcagggagtagtgtcccaaggctgcacaggtcagtgggggcctgggcctggctcatgaaaccattctgtcctcctaggactttggggttgtgatgaaagggggatgctgcaaaggtctctgaaatgccttggaggcctttttcccattgtcttggctatcagcacttggctcctttttacttatgcaaaattttgcaacctgcttgaaacctcccccagaaaatgggcttttctttcctaccacatggccgggctgcaattttccaaacttttatgctcttcttcccctttaaatataagttccatctcctgagttcaagtgattctcctgcctcagcctcctgagtagctggaactacaggcatgcaccaccacacctggccaatttttttctgtatttttagtagagatggggtttcaccatgttggtcaggctggtctcaaactccagacctcaaatgatctgcccacctccgcctcccaggtcatttctttgctcgtgcgcatgagcataggttattagaagcagccaggccacatcttgaacactttgctgcttagaaatttaatcccccagataccctaaatcatctttctcaagttcaaagttccacagatccctagagtaggggcacaatccaaccaagctctttgctaaagcatagcaagagtgacctttactctagtttccagtaagttcctcattttcatctgagacctcctcagcctggacttcactgtctatatcactatcagcattttggtcacaataatttaacaatcttctaggaagttccaaattttccctcatcttcctgtcttcttctgatccctctacactcttccaacctctacccattcccagttccaaagacacttccatattttcaagtatctgaaactgctgtaccatttcaagagtagcaatgccccactcctcagtaccaattttctgtattagttcattctcacattactataaaggaagacctgagattgggtagtttatagagaaaataggcttaattggctcacagttctgcaggctgtacaggaagcatagtagcttctgtttctggggaggcctcaggaaacttacaatcatggcagaagataaaggggaagcaagcacatcttacatagccagagcaggaggaagaaatggagggggaggggctacacacttttaaacaaccagagctcatgagaactcactcaccatcatgagaacagcactgagaagatggtgctaaaccattcatgaaggatccacctccattaaccaatcacctctcaccaggccccacttccaacactggaaattacaattcaacatgagaattgggtggggacatagacccaaaccatattacaagcctatgtgtgtgtgtatttttgagagagatatatatatatatgataatatgatatatgatcatatatatatcatacacacacatatgcaatatgaaacaatacactgtaatgttttaaaagtgatcttagggtataaataaggtggggggttttcttattcttatttatctgtatattctaattttccaggatgtttacttgctgcatttgcaataatgaaaattatattttaaagaaaaaataaaatccatttagtactttcattttgagcagtataaaagaatagaccactcccattgaaacaactaaaagtgctagataagacataaaaaccccttttaaaccttgtagtctgttttcacatggctgtaaagaactgcctgagactgggtaatttataaagaaaagtggtttgattcacagctctgcatggctggggaggccttaggaaacttataatcgtggcagaaggtgaaggggaagtaaagaatgtcttacatggcggcaggagggagagagtgatgggggaaactcccaatcactttcaaaccatcagatctcataagcactcactcactatcataagaatagcatggtggaaaccacccccatgatccaatcacttcccgccaggtccctccctccctacaatttgagatgagatttggtggagacacagagccaaaccgtatcaaacatattaatgaaagagaaaaaaaaagacttctctaaagtgaaaaaaaagtaaaaaaggaagccagtaaatttacttcagttgtgggcatgttaaaatttctagagttgacactaaaagcatagaaagagtgtagaacttctaaactagtagagatgaaaaatagaatagggcaggagaatccgaaaaaaaaaagaagaaacaaataacaaagacaaaagtgtatggtaaatatttacccaaatatatgttatgataataacgtaagtgaaccaaaggattcagtaaaaaaatgaagatgaccaaattggattaaaacatctaactacatagtttacaaaaggcacatataaaaggatccagaaagtttcaaagaaaaaggataggagaaaagtcagaaaaatagtagccaaaagaaagctgtcatcactctattagatattttatagaatagctaggtagatagataatatataaatatataataaagataaagacatatatatgaatttaaatattagatatatgaaagaggctgggcttggtggctcacacctgtaatcccagcaatttgggaggccaaggcaggtggatcacctgaggtcaggaattcaaggccagcctggccaacatggcaaaaccctatctctactaaaaatatgaaaattacccaggtatggtggtgcatgtctgtaatcccagctacttgggaggctgaggcaggagaatagcttgaacatggaaggcagagtttgcagtgagccgagattgtgccactgcactccagcctgaacaatggagtgagaatccatcttaaataaataaataaataaataaataaataaataatacatgaaagagagcaaaaagcatttctaaatataggattaaaacaaaataacagtttttaatttaccaggaagatacaataatttgaaatttgtaggcaactcttaaaatagactcaaaagacaaagcaaaaatgacagaactatgggagaaaaattcaaattgacaattatatgggaaattttctcatacctcttttagcaattgatagatcaaatggacaaatatatatatatatataatgtatatgtattattaaagctggaacagatttgaacactataatcagtaagatttttttaagggaactgcaaagaacattacagccagaaaattgggagatacaaactcttctcaagtgtacatgaaatatttataaaaatcaacaacatattgggccataaagcaaatttgaacatattttaaagatttgggttgtacagaccagagtgcaattgttagaaatcaaataaagagataagaaaaaaatattttatttgtataaccatagagttcagactgccataaatttagttatagtctggcaggacaagctggccatagagaatcctctttagggttctaatagatgagtatcagtgaacgaccaccaatcatccaggacaaaattaatgtttgagtttgtgcataaagggttgatttggacttcacaggattatttcttctttgaaatgtgggaaatcatttgttcctacgcaattcacaaggctatctggttcaacccatgctttcccaagtcaaaatgttctttcccacagcccagcaagataaagtactcaggacagctggattttaagaacacctttgtgagttgggtctttattgggataatcagagaaaatgactacatttaggtcttctttcatattttatactagtaccagaaaatacaaattgggtgcagaaaacctgggtgcatgaacattgcatgtttaaaccaagctaaaaagagaatttgtagccaaactacaatggaacttattgatgatggctagagaactgctatgtggtaattttatgtttgacatgatatgtagttctctttacttttatttggaaaatattctggaccttggaaaagatgagtgtgaatttaactatgtgaggttagaagcacctctgggagccctgtggtcagcagactcttcaggttgtaactagaaccatgaatcaccattctggacacatttagggtttttaggtctgtttctattgatttacacaacactctaggagaaatcacagactcagagataacaccatttaccttgaaccgtttcatctccaggtgcaaacagaaccctgggcaattgttaaaggatgttattgtaggatattgagaaaaagggtcattgcatcaaacaagaggtgacaagatgacagaaaaggaatggaaggggatagtgagtttcaaagtgagtttgagtgtaactgtgtacatttggctcttggctagagccagactacaagttactcagtggataactaacactgaaagaatctttttattgcttgccttatctgagctacttagttcaggagcgggagcaacggtggggccggccttaacacagtgcttcccgagctgcttcgcgccatggattcagagaaggatgattccttttcagtgcactgtgggaggctgccagccacctggaccagcctaagcctactctctagcccaggtccttccctgcacacaccccaggctggaagagatcaatattgagtccaatattgagaagctgatgttaggacccccaaatgaagagctgtgttacaggtatctcaaacttgacatccaaagcccaatgcatgggcttccccccatcgtctacttctcccacagagttcccactgcagcaggcggcaactccattctcccagttggccagacaagagctctgaggttgaatcctgactcagctcctctccttacaccctgttatgggctgaattttgtttctcaaaaaagatacgttgaagttctagccccgaataactccagatatggtcttatttagatcagagtcattacagaggtcattagcgaagtttagataaggccatacagagaagggtggatttctcatccagtaggatggtgtccttataaatggtggaaatctgaacacagacaggcacacaggggaatgccatgtgaagatgaggcagcgatcagggtgacacttggaaaaaaccagcaaagactgcccacagcccaccagaggcaggacagagcctggaacagacctcacagccctcagaaagaactggccctgccaacaccttgattttggacttctggcctccagaactgtgtgacaatcaatttctattgtttaagctacccaatgtgtggtattctgttccagttgttctagcaaagtaacaaacactcctcattcagtccaacagcaaatcctctgagcactgccaggcagagcctggtcattccattctgttcctggcgaggctcccacgatctggcccctcagtatcactcccagctcacagcctcactcccccctcttccttgatcatccctcgcacgctccccactcagagctttggcacggtgcctgctgttcctccacctggaacattctttttgcagggatccacggacctggctccctcatctcccccaactctcatcttcccagggggttcttcctgaatcactccacacaaagccacagtacccctccccaaccctcagtaccgaccctctaccctcttttcacatactatgcattttgattcctgtacactgtgtagctcaccacatcaagtggtgacatttatgaagctggggaatcttatctgctcttttcactactgtagtcctagcacatagacagtcccttaatttataattatggaatgattaaaggaatgaatgcttcttaacatccacgacctcctactcagacccaagggaacaactctctacctgtgccatggtgattctataaagcctggccctgatgggtgggggctgcagatcttggcagcagaagagaagggttgcctgcaccatcctaaactgctaaaaggccacgcaagcgtggtttcaacaggaaacatttaaaggttccttacgatggccaaataagaagaaaaaggaaaaaggaaatggctcatgaaactacctgcaacaaagaaagagaaaaataagatcacagaagaagccccacatgccaaatggcaggtttgcatagcatggggttgacagagatacaccaggctcatacaacatattttggacccagtgtgaaaacaaagaaaagaaatagagcaacactgttaaagcttccaaaagcaactatgatttctttgtcattcatattattatttcattatactgtggaagcaaggaaacttacaaaacacattaagaggcagttcgaaaaagaaaccaccaaaaggcaataaacatataaaaaaaagtgtttaacctcacaagtaatccaagaaacacacattacaacaaaaacaaaacattttcctatacactgggaaagtttaaataataatatccaacgaattccagaataagcatagcaatataaaattggcataatctttctaaaggaaaagttggcattatgtatcagaagacttttaaaacttatatttcattattcaacagtgcttatagtttactccaacttgcccataaagttttttgtatgtaaaagataatggcaccctccagtcagcccatcgccatggattttacaagctggaattggaaccaaagtgtgtcaactccaaaaatcatggacttaagctctcagcgtcccacaagagggagagtgggcctgccaaacttaaaaaagactttagattcagaactactttcagtctattggcaaatgggatgtaaaacactttctttttttttattgagacgtagtctcactctgtcgcccaggctggagtgcagtggcagcgatcttggctcactgcaagctccgcctcccgggttcacaccattctcctgtctcagcctcccgcgtagctgggactacaggtgcccgccatcacaccaggctaattttttgtattttttatagagacggggtttcactgtgttagccaggacggtctcaatctcctgacctcgtgatccgcccccctcggcctcccaaagtgctgggattacaggcgtgagccaccgcgcccggcccaaaacactttcactctatctagtaaaagccacgatttgacctgcagaatgcctgaacctagataattctgagccaaatgagacagcatatggagcatttaaaaacccaagcacagaggacttccgactataggaacacattaccaattcacatcacaatgatgtacttagaaaggttatcttaacaagaaattttctgacattcacatgaataaacgcatgtacacatctgaatagatttaagatgcgtgcttctagaactctgctaaagagctttaacttgagacacaaaacaccagttaccttgcagtctcaagcctaagcaatttagcattattttgaaagcctttgtcataaaagcaaacaaaagacaagcagggctttgcagtgtctcagcctgcccctcccgtcagcccattgccacgggattttacaaggttagttgcaaacgtggacaagacaactctggtggtgagctcttctctcggaattaatacatttcaaagtcgagagccaggcaagtggcaatgctaatcaagctagtgacagcattaatctcctttggctcagctcaaaataggatatgccacaggtgaccccaagtccttccctccccttctcaagccattagctgaacatcatatttctttctgctgccaacgccggcgccagcagcagcacaattcaaatgggggaaagagcacatgtgacaagaacagcttattaactctgtccgggaatttctgtgctcacctatggctggttctaaggtattctctccatttgccaaaagtaatgagaggacagccctttgccaattaccctacacacctcacagaaagatgaacagctaaaagtattaagattcaaatttaagttgtgtgttacaacaaccaacgaaaggtttttgccaagggaaatttcaggaagtgatttaaatagaaatgaattgtcaagaaaaacctaggtgtcgctattctattgcagtatctcagtcatgacaaggtgccacaaatgatgtgaaattacggtctgacaaggtatcagatctgtttaaatccagccaagctctaccatgaaggaatggcttaaagaacaaacctggtatgagtgtataaatcattctccatcaacaagcgttctatggagaacctagaaaacccaatcctaagatctggaatcatctgcgtaagcagggaaataccccttgatgctaatttccattccttaaaattctaaatgccccgtaatttaaaggctaacaggctgtaaatctcccttttaaaagttctttactattacatgcagatgcccacgtgcccttctatccagcttataagagtccaggattctttcccaggttctctgttttgatcaccttgcagagactaggatggtgctgcagaattcggattcgcttctgttggcagcttcccactcttgtcaagcagagtctaagtcattgctgctcatttccagatctgaagcacatctttatttctcttctccctcctgcaacatgtggtcttcaggaggtcgccatgttctccccttctgaattacaaattctagcaaaagtctctgaatctattcctttggagaagaaagtaagggaagaaactaccatgaaagcactttccccaactcctccaccatgaacaccttggatcagactgcaaccaggttgacccagtggggccccagattctgcagtgaagaagccatgtttagggacccctgaccccacattcagccacagcttgttggaccaactgtgaacacatgacccaagagccatcaaacagtgggctggcaggtgacttgaagcagaatcccagcagcaggtgacagggaatatgtatacctcagaaaagggggagtaagatgcaatttagagttagaaatgcatggctggagaaaaatcacacctgctgttttcacaatacacattatagaaaggagtgtttgatgactttctgggcctgtggagatgcacaggagatagtgatgtgagatttcaagggtggaacaacaccaaaaagagggtgagaacaagataatcatggcaggggtgtggccttccccaggcttctgtgtatgtgcatcctacaggaaaaccctaaatacctaaagtaatacaagtgagtcacacctccttaaaaccaaagagtctatggaggacattttaaatggcatttaaattaaattaataaaggagagaaagtgatattaaaattaatttaccactgaattatcattatacaatcatttgtatataacttaaaactattttccctaaaaatactgcatttctaagaataacaattattttatatgtattcatatatatatatgatatgatatatatgatatatatatatatgacatggtttggctgtgtccccacccaaatctccccttgaattgtagctcccataatccccacatgtcacgggagggacctggtgggaggtaattgaatcatgggggcagtttcccccatgctattcttgtgatagtgagaaagttctcaagagatctgatggtttcgtaggggcatctgttcatgcagatgcccatgtgcccttctatccagcttatatgactccaggattctttcccagggttctctctttcccccttcactaggttctcatttttctctttcctgacaccacgtgaagaaggacatgtttgcttccttttctgccatgattgtaagtttccagaggcctccccagcctggtagaactgtgagtcaatgaaacctcttccctttataaattagccagtctcagttatttcttcacagcagcatgagaatgaactaaaacaatatcccttggacaatatgcaatcccagggaaaggactaacaccactactaaaaagtaacaagcggccggacttggtggctcacgcctgtaatcccagcactttgggaagacaagaagggccgatcacgaggtcaggagttcaagaccagcctgaccaacatggtgaaacctcgtttctactaaaaatacaaaaatgagccgggcatggtggcatgctcctgtaatcccagctactcaggaggccgaggcaggagaattgcttgaacccgggaggcggacgttgcagtgagccaagatcacaccactgcaccccagcctgggtgacagagcaagactccgtctcaaaaaaaaaaaaaaaagtaaccagcttatgtaccatatgtaaatttctgtggattgtatctcactcaaaaatggtctggttaaaaaaaaaggataatagaattcaacatgtcattaataaagttacttgaaacaaccagtgctaatgatttcttttgagagactgaatatataagcagacaattgccagaacatacataaaaataaaactgtgccccacaactgcagcaaccagcccaggtaaccaacttattatccatagcaaccagcccaggaagccagcctgttctctgcaagttagacttgcagaaagtcagaccactctccctcccttgtaacaattcaggacgccaaaaaataatgcctgtaataattggccccaaatggctgggacttgattcataatcacagtattcctaatttttaccctacttcccatttaggaccaaccagagaaaggcaaatatgctcccccaaccaatcacactggatgccctgctcctggtgagccgcctccagcttcctcaggccagcagcctccaatcagggcacacccagaacctccccttcttccatcacgatgctttccccctcctctgtctgcctctgagtctctgagaaacacaatgatagtggccaacttccttgctgtagcaagctcagaataaacagccttggcttgttctcatttgcttggtcttcatctatttccacgcattgatggacatttctaagaagaatctttataaacacaagcaaggcagtaaagcaaggacagcaaaggagtggggatacgtcactggggcacctggatgtgagaatttcaaggcttgtcttttataccatcttgcctgaaagaatgttttgagtccttattcatatgacacatggaaaaatttgtgagcccatttctgtaaagcatggtttccataatgtatagatttcataatcaaaacaagaatacttttccaacctaatgcaatgacacttccaaatgaaacagtgaaaagaagatgataaaataaagctgggccagctgggtgcagtggctcatgcccataatcccagcactttgggaggccgaggtgcaaggattgcctgagctcaggagttcaagatcagcctgggcaacatggtgaaaccccatctctactaaaaatccaaaaaaaaaaatacaaaataaaagaaagctagaccaatgcagagttccccaagccatcccaaaaattagaaatggaagagtagggaagtcattgttgctctattgatcttatcaatttcctttaaagagcctattgagaaaaaggaaactaataatctggttaaagaggtaaaaagaaaagccagacatcgggtgtccacaactcacccttgctcactgagcctcaagccacaggtcttaaggcccccaccgtgggggttgaaagttctcagcccagtagatgccctgagctgacagcacccccaggaatgggagaacagggaaggatgttcgaaagtaacagaggtaaaatgactttcctccctgcaaccatttcccatggaacactagccttctggtacacagactctcagactcagaaatcagcaaaacaaacaaaaatccccacaaaaaggaaattacagagaagaaagcaccccgcagatccttgtgccacgataaattagttatctaaggaacacaagcagttaaaagtcaggcacgcatcctgtcaatattctgcagggatctagttctgctgaaaaacttgcttttcacaatatacctcaaatctgtcggcaataattacctgagaatcagaaaggtgacattttaaattttagtgacacattaatgaacaagggtaatcctcttgacagatacagagcaagattcgccacaggaagcaaagcaagagctcctcagatcaaaacgtaagccatataaccggccttggcaggcccggtgcacatcaaggccgcacttcagatcatcgcggccccttcagacccctcgcagccactgacatgtttactacttttattttccctggcagatgtttggcagacatctcgtctcagaagattcgtgcctttgtctcagagtcgagggttaataggacccttaattgcggtctcagttataataagatcctgcctttttaaaaagaaatgccttctacaagcttagtaattggtcttcccatttgagatgatataatctccaagtcacagtacaaagttagaacatgaagggaaatggacaggaccctgtccccagacaccgtccatggcatctgtggctggtccccagagccagtgaaagggaggtaggtgcttggaccagtgctcccaggtggctgtccccggaccccttcagggtcctcctggtggccagggcccctgcggacagtttgagcagtaactaagctcaggggcgctggtaagagctgaattttatccctgaaaaactcatatgtttaagttttatcccctagcacctcagaatgtgacctcatttggaaatagggtgattatagatgtaattagttgagatgaggtcattagggtgggcccgaatccagtacatctggtgtccttccaaaaagggacgatttggacacacagacacacagcagggagaatgccgtgtgaaggcagcagaggtcaggctgctgtttctgcaagccacagaataccaaagacagtcaatgaaccaccagaagctacggaggcctgggacagtctccctccagtcctcagaaggaagaaaaccttctgacaccctgaccttgaacctccagcctccagaactgtgaaacagtaattttctgttgcttaagcctccaatgtgtgttactttgtaaacattatgtaaattcccaataaccagccaggttgtcatcagtactaacctttgaactcacgtgaacgagactcttcttaaacttctgagaggtgacagcgtgctggcagcccccacagccctcgctcgctctgggcacctccttggcctcggcgctcactctggccacacttgaggagcccttcagcccaccgctgcactgtgggagcccctttctgggctggccaaggccggagctggctccctcggcttgaggggaggtgtggagggagaggccacgggcgggaaccatggctgcgcagggcgcttgcgggccagtgcaagttccgggtgggcgtgggctccgtcggcccctcaggccccccactctgagcggccggccggccccagcgggccggggcagtgagaggcttagcaccctggccagcagctgtggagggtgcactgggttccccaacagtgccggcccaccagcgctgcgctcaatttctggctgggccttagctgcctcccctccgggcagggctccggacctgcagcctgtcatgcctgagcctcccctccccgccccccacgccctgccgtgggctcctgcacggcctgagcctccccgaggagcgctgccccctgctccgcgccgcccagtcccatagactgtccaagggctgaggagtgcgggcacaaggtgcaggactggcaggcagctccacctgcggcccgggtgcgggatccagtgggtgaagccagctgggctcctgagtctggtggggacttggataatctttatgtctagctaagggattgtaaatacaccaatcagcactctgtatctagctcaaggtttgtaaatgcacgaattagcaccctgtgtctagctcaatgtttgtaaatgcaccaatcagcactctgtgtctagctgatctggtggggacttggagaacatttatgtctagctaagggattgtaaatacaccaatcagcactctgtatctagctcaaggtttgtaaatgtaccaatcagtgctctgtgtctggctaatctagtggggacttggagaacttttgtgtctacctcaaggattgtaaatgcaccaatcagcaccctgtcaaaacggaccaatcagctctctgtaaaacagaccaatcagctctctgtaaaatggaccaatcagcaggatgtgggtggggccagttaagggaataaaagcaggctgcccaagccagcaggggcaacctgctcacatccccttccacgcagtggaagctgtgttctttagctccgcaataaatcttgctgctgctcagtttctgggtctacgctgcctttatgagatgtaacactcactgcaaaggtctgcagcttcactcctgaagccagcgagaccgtgaacccactggaagaaacaactccagacgcgcgccttaagagctgtaacactcactgcgaatgtctgtagcttcattcctgaagccagcgagaccatgaacccacaagaaggaagaaacttcgaacacatctgaacatcagaaggagcaaactccggacacgctgactttaagaactgtaacactccccacgagtgtccacggcttcattcttgaagtcagtgagaccaagaacccaccaattctggacacacttccagcacattctttttgtttcagctactttgccaagccagctgctcttcttatattgtgaatcttctcatttcattttctacaacattaatttatatttcagctaaggtactatggtgcctgaacgccaaataaaaagaaaaatgagtgatcccgaaatataacattttgttgatgtgaggtcataggtttacaaagcattctgatttagagaatcaaaaggaaaaattacagaaaacaaggaagtgagggaaaatgtaaggaaattataaatggatggcttcttcacccactgatcctcattaaaaaggaaaattgagctgccgtcgattgatggttctgttaaaattcaaaacagtggttctcaaactatagcccccagacctatgtggtctgggagaggttctcaaagtgtggtccccaaattcctctggcttcgtcatctgcacctgcacatcatccatctttccccaaccattctctcaagaaagccatttccatcaatagccaattctcgggcttctccccaacccaactaaatcagcacagtgggatgctgtatctgtgttagaacaagtcttctgggtgcttccactaaatgagagaaacactcctcaaatccaggaggcaacttgattccacctgacagcaaattcagcgaagagtcactgccccagggtactatgttcaaaaggattctgaagcagattttaaaatgaagaatctcttgggcaagaaagagaagggaaccgtggctggcaaaccacctatcagtgatctgggagtctcaagctcacaaaccaacaccaatttttttttttttcatatcagtggttccaaataaatgagtgcttccaaagtgctaagtgccatcttagcaaataaaaatctcccaaatttctgaagtgacttggaccctaggtatactgacataaaagtgaaaagaataaaaaagtttgctttcagttctaagacaaaacttgaaataagaacatggtggccaggcacggtggctcacgcctgtaatcccagcactttgggaggccgaggcaggcagatcacgaggtcaggagatcgagaccatcctggctaacccggtgaaaccccatctctgctaaaaaaaatacaaaaaattagctgggcatggtgtcgagcgcctgtagtcccagctactcaggaggctgaggcaggagaatggcgtgaacccgggaggcggagcttgcagtgagccgagattgccactgcactccagcctgggcgacagagcgagactccgttaaaaaaaaaaaaaaaaggaacatggtagcactgctctttcttccactaaacagatattgctccctctcctccccgtacctggctctctttcaggatggtgctattgtagtgatgagatacaggaatttgagctgggcttcgcctaattcaagaaaacaagcaacacacaagacttaaacttagaagataattgaattttcaagttactgtttacgttacactatatgatgaaggtttctcttcacttttaaaaggattttaagagttctttaaaagactatgttcccctgagacatttcatacctgatttgatttatttaactatcactttccacctgagcccctggaagccaagggcggtagctgagtctgcccatcctccagtcccttcttcctcccagcccccaccaactctacctgccggatgatgtggaacctgtcagcatatctctttttttgtggttttttggcttgattgaagtatatcaaatagaaactatatacattgaaagagtacctaccacttgatgtcttgatgcacatacccattgtgaaataatcaccacaatcaggctaactaacatatcaatcaactcacagagttaccattttgaggggtgtgtgtttgtgtgtgtgattgtgtgtgtgagtcgagaatacttaagaagctgttccgtgctaagtgcgtgccttcttagcaaatctcaagtatttcagcattgttaactatagtcacgtgctgtaccttagatctccagaacttattcatcctgaattgaaactttgtaccctttgagcaacatctccccatttcccctcctcccagcccctgcaaccacccttccactctcagcttctatgagtttcactattttagctcccacatgtaagtgagatcatgcagtatttctttccgtgcctgctttattgcacttaacctaatgcccttcagattcatccatgttgtcatggcagtatttcccttttttaaaagactggataatattctgttgtgtatacatactacatttcttttattgagacaaactctcaccctgtcacccaggctggagtgcagtggcgggatctcggctcactgcgacctccgccacccaggttcaagtgatattcctgcctcagcttcccaagtagctgggattacaggcatgcaccaccacgcccagctaatttttgtatttttactagagacagagtttctccatgttggccaggctggtctcgaactcctggcctcaagcgatctgcccacctcagcctcccaaagtgctgtgattacaggcctgagccaccccacccagccatactacattttctgtatccattcatccatcggtggacatttagattgtttcgacatttgaaagtgccttcctttgtccctgcctctgcttctcctgttgccacagatattcccatcctctgtgccctgctgtgtcccttcacctttccaaatcctttcctgttcaatccagacttggatggaggggccccttctctgaacttccagtaactttccagggtcagatgtcacttgccctgaagtcatatactttgccctatggctttgttatttgcacctgcacatccatctttccccaaccacactctccagaatgccatttccatcatatgccccacagcagtaatgcaatgattcaacagattcatttcatgaatagattcattctcaggggattgcatcaagtaagttcctctcatattccttttgggagctttgcatacatatatcagtctccaattgaaataagtgaatttcttaccttttaagggtcattgctggcctcagggaagcactcagagtgatcaggctaccagataatcgacatgattatttggagaggttatgtgacgtgcacagactagaaagctagaaaatccaattctgtcactcatctgcccctaatgaattgtgaggtctggggtattgtggttcttctctggcctgtgctttgaccacagtttctctcgattcttagtagtaaaccacatgatgatcagctaaaacagcttaaagcatcagcaacgtcagcatgttctgaacagtattattaatgctttgccctgtcctcctaaaatattcctctgatccttatattttctagtacaaatgacaggaggcatctctatcttatttatagctctaaataaattggtatgagcatcaaccaaacatatttattttatttcccaagaaatacaccaccagaaaatgtcaaggaaatgatctttgaaaaatgcacatctgaatgcaatatgaaatatttaagggaatcgctgtgcttttggcttccattttctgttagattattctacaggctcttgtaaaagtcaagtcagtgcttttaaaggcagaatgtggctgcaagttaagaaaagccttcaaagccctgggttcttgatttcccttttactttcagcattttgccttgaatgaacgacctcaaataacttagatattcaaaaattgatgaatggcacttagcaaggtacaactcaaataaagatgatgagaactaagtcagccaccagtggcctgaaaattcatggcagcagcatgcttcctgtggaggcatctcttcgtgacattttcaaagggttcttcccatccatccactttcccaaaatcctctgcaatttaaggaatatctcccacactggcctgtggtgttaaaccagcaaatcatgttgggtgagcaaaaagaactcaagaatagaagcttactctttaaatatccccctaaatccattcaattgagttggctgggaagcaaatactcacatagattaatgcatttaatcctccaacaactctgtaaggcaacgactattttacccccattccaagataaataaatggaagcacagagagttggaataatttgctcagcagtcacacagccaggaagtggccaagccagaatgggactcagctggccccagggcctggggtgtccaggccccatgctacactgtccccaccaacatgttcactccacatgtgctgatattggtctcgcacatgatgagttacatgaaaattttggtgaactgaaggttatcaaattcattagtaaattgcattggtacaaatggctgtggcctagggaagaagggtaaagcccataagaaatgaagacttgctcaggatctataaaagtaaccccaggaaaacatggcaagaccaaatcctgttgtctaagcaggcaagggaggcctctacagacaaacctgaagaaagatccactgctcaggcagcaccttatcacagctctgggatggccagtcgggggccgctatggaggacaagcctggacaacagttttggacagctgtagatagtctaaatccaacatacatatagccacctcgacagactgtctctggttagctgggtaactgaggctcctatgccaagaccttccacactggcttcttatcactggaccattgaagtcaatatctctgcactcactagctactgaccttgagaaaatttagtaactttttggggccccagtttccttatctgaaagatgaggctaagaagacagctccactggattattatgaggagtagatgagacaacccagaaaaggtgtcttattagcataaagtacttggaacagtgatgtgccccacataacagctgctgctgttagcactgaggtcacctacagcagcaaagggagctgcaatcataggctccactccccctttgccatcttttgttaactgccttgtctagacttcacttttaaatactccagatatacagtgccatatgaagtgtgctgcaggtgtcctcactgagaattcagagcccatagtagaccctgaagttctattcaggagcccagacgtggggcagctactatgagcactcttgttattaaaaaagctctgttgaatatcaaaaatggtttgatatcagaaacaccagaaatgagctataattggtgacattaaaagtattcaaaccatatggtttcttagtccatttcagcttctataacaacctaccttagactgggtaatttataaacaacagaaatttattgctcacagttctagaggctgggaagttcaagatcaagatgctggcagattcagtgtctggcgagggcctgtctggcataatcggtggcttgttgctgcagaaaaggtcaaatagctccctcaagcctcttttatgagagcatccatcccatccatgaaagctccaccctcaggacctcatcacctcccaatggccccacctgttactactactgcattggagatcaggtttcaacatgttaattttggggagaggacatcaacattcaaaccatagcataaggattggttaaaatattcaagaaatcttctctaccctttgcaagaagtatctaataatgcccagacccttttccttggtggagatgtgttatatagccttataaaatagcctaataggctattacataaggactttaggtccttaaattcggaggatctcgtatgcctgatgccagctctaggggtgacagaatctgtttccacagccttggcactgccttctggctccctctcctcagtggaactctgagcacctaagagacagggacctggacttcattaagcttacagcacaggttgatgagcactttggggcctgccagcaaattaatgttcctttaataaatgttttgtgtgagctgaagctgctttgagagttgctgtcacaaaaattgaggagcaaagagtcaagggatgagccaggtttcacctgcttcaaacttccttagctacttcttgaacctatcaaaaagaaaccaagaggtgtatgtgaccaaattggcttgggtacgtgaccaattgactttttcagtgtgcctgtgccataagcttcaaaaaggaagatgcaaggcaagtttcctctgcttagtagcctctcagggtaaagagagctgtagctacccccacggattagcaggcaaaagccaccaaggtcaggagatcatagtcaaggtcataccatgaggaggtggacaggacgagaaaagattcaagtaagtagttgtttctccctggttgccgtgaacattaagcggccaacttgaaataagctctttttctctccccacagcaaatataatccaaaatccccgttagaggcaaatacgagtatctgaattcagatttccaggtccccggcttggagaagggcagcatgggtctttatcagaatccagcttcgggatttcctggactttaaggatgcttgcttcaaccaaatgccctgggtggcccctttatattgaagaacccgtctttgactccatcctgacctgctctccttatactgggaagtgtgcgtataaacgtaccatttcatgaaaatagcatgtgtcaccaaatgagggttccagagagtcagcagcgtgcattcatccaagaacattggcctgagaaaccctggccaccatctgccagaaacttgagaccaagagctcatggaaaacagaaactgctgctctgttcagcctctgtaaagtgctcagtggtgccaatggttcagcaggctcagaagactatgacatggggtggggacacaggtgaggacatctctgtcatttgaacaaatttccaaatcccaaatcctgagcagaagtgcagagctgaatgtgcataatgtgcatgtcagttgatcggggaaaatgcacttcctctatttagattctctgaaaatgacctcaaaagacatgagcttagttacagctcagcgatgctcgttgccacaacaagaaagcccagactcagtgcagcagcttaacagcaaaaaggtctctttgttcatggagtccggtgggccatcagtgctcctacatcctgcagccatatgtaccatctggggcaagtgtcaggtgaggttgccacagccagagaagagaggacaagagggtcactcgggatggttttaagagctgggcttaatcacttttgcccacacctctggccagccccatcactcatcctgcctggaaggaagcctgggaaatgtgggggatgccacaggtaagcggggaacccacaggtaagcaggaagatgttatagtgtctaccccaagaggtaagccactctggatgtgatgtgtgtacaggacctatcacaaagccctgagccccaaatcctcctccctgctcacatcctcacctgccacagattccttctctgtaggataagagacatttgggaattcatgatactccttctggactagacatgccacctggaatggatgaaacctgttttcataattaataccatttcaaggtgctggcatgtgagcaggaatgataaaactctagaaattcttcatgaccgatgtcagagtccaggaggtacaggtgagttacgaaaaccaagaagaggtagattgagaaccgaaaatgagtatgagcccaagtcagggtcaagaaaaggaatgagctgctaagccctcggggtggcagcaggtggtggagagatggcaagaagctgtgggaggtgagcacagggccagaagcagggaagaagcaatcgaagagagaagcagcacaaggtggccagaggcacaggaagaaggggctgcctgctgatctgagcagaggtccttgagtatcattactgaggacccaatggaggactccggaggaccatgggtgaatgggaggtgagggaggcaggggaaggggctacttgtgcctccaaccagaaattgagagacccccaagtatgtgggctctactcgaactcctctgacctcccacaagctgagccctgcccccccacaagctgagccctgcccccccacaagctgagccctgcccccccacaagctgagccctgccccccgaggccaattcctaagcctgttcacaccccactgccttcgctggcctccatgaatttcacccttttttggcccaaaagaaaaataataataatttaccagaatcctccttcttagctagttcctgggctcatagttctggcctggtcctctctctgttctggtatcatccacaacctgccataagagtgaggtttattttatttatttgtttatttatttatttatatttgactgcctagggtatgggtcttaagcccgacctttccaaacatgttcctttcctcagtccaggatcttaaatctttcttaaaccacttcaagaaagtggtctgtttcctcttctgcctatattactatacatattaaagacagtcctgattctcagcatgagaacatttatctctataggtcactttttcaaaaaggttaaagcaattgaaaaaagccttttccttgatatcaaagccatagacttagatgattttttaagcctaagaaagccctctctaaaaaaaaaattaaaaatacaaaagaagaatttcctaaaaagaaaaatacctgctgatttttcttagcccagaaaattattagttcacaaggtgaatttccccgtgaataaactcaaacgtggatggggaaataaatcatttgactatccacaatttttctttgtaaccgtcatcttgttgaaaaaggccattattttttgtgctaacggaagtgccttgctaggtaaaatgtatacactatctcaaatgtatagaaagattcatctttccagtgcatttacttctgttagctaataaattccggcagaagtgctacaaattacattacaggtataaataccagcatgtcagtggtgtgattattaagacacctgacttgagttcacccttcaatgaccttgacattatcttggtccctcttgcctgcatatactgcgccaaatgaaccaccagggatgggccattccttgataaacacatgtcccagagtttctatatttttttcccctacactacatgtttttaaaaatgtttttttaaagctgtcctcttttattttggaaaatatgtccatcagagctatagccagatctggtatcagctctccctgcctgcagccattccactgggcacatgcccattgctataccagctgttaagtggcttgaacagacctccggctacagctgctttagcactcatttccacacacaccctctgctcccctcttctccttgatcccctccagcctggcttccacatccaatgctccatttggactgctcattcaagatcagcagggaccttcatgtcctcacaggcatggaaggtttggagtcattatcctgaacaacagccagcggtaggacagtgcatctcactccctctttctccaagttactcttattttctcggatgccaccttcctctggtttggcttctgccactccagcccctcctctgggagctcctcccgcaaacctgtccttgaacgttttgtttctcagagctcttctcttctgcctcccctacacagccttatcaactgtgactctcagaggatcatctcttggggtcagtcaacaaatctgagtgaatgtccctcaggaagctcaaactctatgagtccaaaatggaactcgacatcattctgcaatattattcatgttattccagctgctactgaagaagagagcgccctgtctagtgcaccctggaaatggtacccaaaatgtttggcttgctcaggcaaaaatgtgaacatcttccttgccacctccctcctatttcacttcaagtaagtgccctgcatctgcctcttcagcatatgggtttgctttggccactcccatcctcaccacactgctccgaaggcctctcttgcccctcccagcccatcagcctcaatgacctccatgccctagttcattctcctccaatctcacctcaacactgcagctggactgaacttcccagaacttaaatctgatctgtcactccactgctttaagactttcaaatgagtcttcgatattttttagggtctttaggatgaaatctgaactcttaactaactcaggcactcccagtggaggagcctgtgtacttctgtagcctcgtctctctgctcttctcctggcatcctctgatgggcaggaccacgccccactaccctctcgctgtctccaaattttacacaagctgctccatctgcctcgaaacaatgccgctgcctctgcgccccctctcctgacacccactcattcaggtgcacccatgggaccagctcccactacccctccagttgtggttgaagaaatatttcgctttgggagaagtttcctgacctcatggctgagatgggtcttcctgtggtgggttcccttggcacctttgctcccccatcaacataatcatcataccttaatttttttcctgaattgtatttttttttcccgctaaaccttaagaactactttggccacagagctactttgattcattccctgctatatctccaggacaaaacagacactgggtaagagtaggcactaaataaatattgaacaaatagaagaaggaatgaatgaaaagggaaattaaacctcacctcctccataaagcccgacccattacttccgcccacacgagggtctctccagcctagcactatcagtattttgagcaggacaattgtttattttggaaggctgtcctgtacatcataggatgtttaacagcatccttaaataccagtagtacaagcctccctgcaagttgtgacagtcagaagtatttccagatggtgagccatgagatgtgagaaccattggccctcactggcccccctcccttctctgaccctcttcactgccccttgcagtcatcaccatctgttatcacatggtttttctttgccagggccatgtacaagtagtcttgtcaccccaaaaggaggaaatcctccttgaaaacagggctctgtcctcttggcatcccgtgtaacagctcatgcaggactgattgtagcaaacaggattggcctgtgtggccctccgtggaaagggggaacaccaacgtggccacattgtacgtgaaattctgactctctaggctaagtctgtcctttctgtacaaatatccttaacatctcaacattggaaaacagccttattgcaagctgctactgaattcttgatcgcatacagtgctgttctgtgtgcttcgtaaagaggatttaaaacattgcagagtgaataatctcttcatctggaattcattaaactctcattttctaaaaattcaacaacgtcagctgaacccatagcaagctgcccatgcctcagtggtcacttgcttggaatgccgcttcctcccggtaactcagtttcaccgcctggcacattcaggacataaccgaaggaactggagccaatttgcccttgaccctgtagcatgacatttgacttcccttaaactatcttagatgtctcctgtgctctttaaataaattatgatgataattaatatcagccaaaaaaatcaatggttaaaaattaattatttatattaaatatttagcaagtattcatatactaaaggtgatttagcactgtagtagtccttaaaaacaatccaaacatgccatttcctatcattagaaaattacatttgtatttagaaaatcatcttgataaataaatgtgcacacagtaaaaacgggaaaaaaaacacagtttaccttcatcgtgtgcatattctcaaatctacaataagtcagtaagttcaacaaagccttttctgtgagttcagccatgcagaaagaacacctctcaaagttgtgactctgctctgagcctgtttctgccacagtcaccctgtgagcttgagaacattttcctatacatctccctgggcctcagtttactcatgtttaaaatggggagaaagggccaggcgcaatggctcacgcctgtaatcccagcactttgggaggccaaggcaggaggatcacttgagcccaggagttcaagaccagcctgggcaacatagggagactccatctctacaaaaaataattatttttaaaaaattagctggacatggtggtgcatgcctgtggtcccagccactcgggaagttgaggcaggaggatcacttgagccaaagagttgaagctacagtgatccatgatgtgccactgcactccagccaggtaacagagcaagaccctgtctctgaaaataaataaataaaattaaaaaaaaaataaactgaggacaaaaattccacatgaaaacccaaggtcccttttggaactaaaatttcatagttttgagcaaatcccatgacactcttatttatccccaaattgacttttctgttccttattaattgacaagtgacaaaattggtaaaatcatatctacactgtcctggaattaaatggcacaaaagagaaatccatcattttggcatagggacaagtttcctggactcagaagttagcaacgaggggcttacatagaaatatttacatagcagaaagctccagatcagcagacttaaaagaaaatatgcagacattcagaaataaaggacgatagaaaataaggttgcaagatggaagtaagctattgtgaatagtgctgcaataaacatacgtgtgcatgtgtctttacagcagcatgatttatagtcctttgggtatatacccagtaatgggatggctgggtcaaatggtatttctagttctagatccctgaggaatcgccacactgacttccacaagggttgaactagtttacagtcccaccaacagtgtaaaagtgttcctatttctccacatcctctccagtacctgttgtttcctgactttttaatgattaatgggtgcagcacaccagcatggcacaggcatacatatgtaactaacctgcatattgtgcacatgtaccctaaaacttaaagtataataataataaaattaaaaaaaaaaagatggaagtaagcaataactgtgaaactcagagaacacatccccaagaaaggacctggcaccatctttgttgttctctttgatgtggttgttccaaattcaggaattcactttggtaaactttctcttggagggtttcctccctttcccagctctctccaatgagcatggaaaatgaccacggacaaacctgagcgtagtatgtattatagaagcaagaagtagaaaatgcactaatgagccaaccagtggatcaactccacatttctacagttattaaggcagtgacatcagtcaaggctcatttacaggaagcagaaactagtctagctattttaagcagaacaagacaaggcagggaactaagtacctataaaattgtcagaaggtttggaagagtgagctgggcctccaggaataactcccggaaccaggggccaaactgaccctcggaggccagttagaaatacaggagttaaaagtgcagccctagtacaactcgccacagggaatattggctcctcctgcgccaagctggggacagaaatcacaatactgagttcctctgccttcaaacgagcgatgcccaaacactgcaccggctgccaacactgctgtgaagtctgcaccatccagcagctaaaccctgtcatctccatgaccctacttgacagcagcaacagccaaagcacaagaatgagtgtccctctgaacctgcacttccaaatctcagcaagccgcctctgaaggctggaacccaattcacattcataaccagagttgcaagggagactggcaatgtgatggtttgcctccagactctgcggtaaaggaaagctcattctgtaatggaaagaagctggaattcacattgagttccagtccaccatatccaccagagttgagatggaagacgcaagtaaagtcccccataagatcctaaaagcagtcacaaagctactgtccaacaaatctcaactgagttataagacttctccaggtcgacttttatcactttacctcaaggaagacataacattttgggatcaatattttatagatttgcatatgctataaaagtcttagctcttatatactccctgtacaatgtttaagtgattttccataagatgaagaggtaataaaatagaaggaagtctgtgactttattcactcacttatacatttaccagcctgctataaatattagacccaggtgctggaccagacatggagatgccaaggagaaggagtcatgggttaagatcactcgctttagcaggaatcatttccagtacaagtcccatttctgccacttaccagctatgctaccttgggcaagttcttaatctgttctatgactcagtttatccacttatcaggtgagaataatgatacactctttaggaggctgtcacccaagggttaactgagataatatgtattacttttagtatagtgatttgaccatatattagtcagggtttgcagagaaacagaaccaatagactatgtgtataaatatatatacagagagatttattttaaagaactagataatacaattgtgggagctggctagtccaacatctgcaggatagggtgggaggctggagacccaggaaagagctgatcttgcagcttgagtcgaaggcagtctggtgacagattccctcctcctctgggaggtctgtcttttctcaagatcttcagctgattggatgaagctcatccacattatggagggcaatctgctttaatctaggcctactgatttaaacgttaatcgcatccaaaaaacagctttaccgcaacatccagacttatttgatcacatatctgggtaccatggcccagtcaagttgacacagaaaattaaccttcagagtccattaggagcattcagaaaatgatgctgttgtgattaagctataatcaaagacttgaaggagtttgcatctagtggtaaagatagataatcacagtgccatgtgatcagttctatgaaacagatgtttgggagaccatgggtacaggcaacagggtgtatgtagaaaaaagaatgccagggagggctctgagaggtaggaaagaaggcttatgttgcaggctctgggatggcctctgccgatgcagatgtctcaagagtaagaagaaaatcctatgtggacaccagaaagaccagagatgtccagttccccctcaccaggcctaagcacgttagggttcagtgaaaatatcttccttaaattgggagggtcccccaccggtctaggtgggggtgagtattcaaggtagccacaggcagcagaggtggggatgaagagtcagagtcatggtcaggaggtggtgaggtcatggtggggaaaaaaagcagggcattaagcccaagggaaagaacagacaccagacctcaagcttccagtcaggagatgggacagtcaacatggaaaataaggagtgaggacaggagaagggaaagcttagaattcaactgcaaacgcaagcttgtgcaaaacactgccccgcccccactcctccgcatttacagccatggcatttatagccaggtagcactagagcagcagtggactataagggaccatgtggaaagggacaagtggaatcacaagcccctggtgccaacaaatgattgaccattgttggtactagagctttgacccctgaaagaatccatttgcctgtgcaccatggaggcacaaagtccagaagccaacggccttgtcatgacgctttcccaaagagccatcctttcctagccgcctcgacccacaacacccaaggggtacagatgtcctcatctccagtcatttaccccagcctggtccattcccagtgaggttaaggttcacatttaagccaaaatttccagatgcatttcttatatccttgagccgtaaaaattgagtgcttggtccaggttacatcctgggtgctcagaatgttttgctgccaaccatttggcccaagtctcaaaggcgttcctccagagtggagatgctaataggttttgagcgagtgaaaaacatttgacaacaaactgaaacttgaacatattgatatctccatcactgacagcaagagccggagagagacaagcgggattcatcttgattggcgtgtggcaacaatagtgcatagcctccaagttctcccggagccatgtgtgctgccaattgtaaaagggagaaggatgacaagtggacggagtcctttgagattgttttccaacataaactgataaaaaggcccactgggcattgatgttagaaagactcaagatagttaaacctaaaaaaagagtctaatgcaaaatcttttacctgacgtctcctatattttttacccttctgcaaattttaggtgggtacgtgaatcatttaaagccatttctgtcttttctaaacttccaattataccacccacagcaccaaatggaaggggaattgtaatcaattttttaactaaattcatgtaaaataaaattagacccaaaggatctgaataacaaagccattttattcaaccaagaaatcagattttgacagccaaggttttttttttaaaatcgaatctattttccagagaatttattcaaaatgctcaccagataccaccaggcactgtaacagaactacaactaacccactgttctcatatgggtcatatttgtaatgggaaataacacattagatagatggtgacatgggttattctcccagcgtgggcaccaaggagctgtacatcctgagaaagtcacttcatctctaagctttgtttctgtacctgtgaaataaggtgctaaagttgatgcaacgatgacccaattctttacccctcttatatgctcaccctttaacaagtaacttactaatgccccccactctgaccctaggctcagccacatgatttcggtcaatagaatacaacagaaacaatgccccagttcccagcctaggctgagtccttgcaggtttctacttactttcttgagcctctgccattgccatgggaaagacaaccctggtccagctccctgagtcctgagaaggaagagagacaggtagagcaaagatgagtctcccagctgagactctccagccaaatccagtcaactctcattccacatcagcaaatgcagcagagatcagtagagccacccagctaagccatccatgaaaataaataactcaggatggattgttatacaacaaaacctaagttgcacaggacaatacaacccactccaactatcttactagcgtgttgggaagatcaactgcaaatatatatatatataatgcgtatatatatgtatatatatgcatacatatatacatatatgtatacatatatatacatacatatatgtatacatatatatgtgtatatatacacatacatacactcgaaagactgcaaatctgcctcccagccataaggaagaccacatgctctgtaacccatatgccctattcctgcatcttgagcggtctttccaggtggaccctccattctgaaattaacttccttggaggctcaatttctatatgacaccttataaatatattctgcctttctgctcagtccctttagattctggtagacagcatgcttcactcattcttctaacccaccccatctctttcccaaccaaaaaaaagaaattttttaacatctcccttggcttcatgttctgcggaatctagggccagacagtcctcctcctcctgaatccacctgcttcctgtaccctcatcggttattctccagtcatgacttaatctgggaggggactcaaacatatggtatatcattattacaaaaggtcacagcaaaattaactttatgccagagaaactgtttattctactaattgtcacttagatggcttattgaatattgggtagcttagtaaacaaaccctttcccaaggctacttaaatgtatgcttcttcttgctttgtgctgggttaaatggaaccatagttagcagagtagagagttgctttccttcagggtgggctcagaacatgcctggaatgctaccttccctggcacccaatttggagacaggtaagggaaggctaacggctgtcctggggtaaatgctgtgcccttcattggtaaattgtaggggtccatgccctgactagcgagggacacctgaaggaaaactggcacccaaggcacagccaccagcatagaaaccaagaaggttgttgtgggaaggagcagcatatcctaccacagttactgaccacagcctgacctgctgccaactgaagcacgggagaaacggaatatccaagcagcactggcacagctgattatctctccttactcagcctgtctccaggatacaggagtggagctgtggtcaatggacagcttgaaaaatagatgatctctgtcctagatccttggctacggggccaaatacttattaccccaagaggtaatacgcaagcccacctaaaataagccaagcaatacctgtgaaagaccattggtacctgtgggtgtcattagataatatggagactaggaacatgaaccctgaagtagcaaaaaaggaatcaaaaggaacagctgacaaaggaacaaagacccaggacccacaagaaaggcagaatttcttccagtaaaggaaaatactctaagtgcttttaagactttttaattatcagttcacaggcatctgctgaatgcctgttacaggcccatcacaaaggctaggaggaatacaaagaaaatcaagatatactatctgcctcagaagattataaaactggtgtaaaatttcttactaaagcacaagaaacaatagctaagaataacacaacgcaatataattatacgtcagttgttctcaatttcctgtgcaattgagaatcacttaggaggcttgttaaatgtgtattatatatattttatatatatatatatgagatatatatatacgtgaaacatatatatgtcatatatatgtgtgtgtgtgtgtgtatatatatatattactgaagccaaagtgcaccaaacctcatacatcaggatctgcaggagctgcctagggaccacgatgcacacctggttaggggaccctgggatgcacacagtgctctgagaattcagaggagatggagtcaatggaacatcctggactacttggaaacagcagctactctagacatcagtgctgctcccacagggagaagactgactcccaaatccagcaaggaaatgctggatcatgggcctggcacactaggtgttacattttaagataatgctaaaattacttaactcctgttttccaaggctggccttgagactttcagaagatgatgttcacgcaatttgcccatggctcaaagtaacaaggtgtcagatcactaacaagtgatctgaaagctccctatcagctcagaaagaacgacattcctaaaaagcattcaactatttcaaactattgcttaaggctacctggtggactttgtgctgtcaaagatcccttccacctcaaatagaaagctccccaaaatacatttctcttctggtaagttattatcaataggtgggacctgagcagtctgatatctttctggccttgtatgagtcactgtgcagaagtacagattaaactaaatgatgaaagcttttatcagatgataaatgggatctcaaataagtactcagacaatacaactgtacaatggaaaatccatactttagtgtcctaaaagaggcatggcactctgcttcaaatgtatttttaaaataggcattcaccaaacaaatgctgagtgtcccctgtgcttagcacagtatcaggtgcaggggacacagtggagagcaaccagacaaggtcttgccctgtggtccagcgacctagtaaatggaaccccacccaagttctgaatgaggagggaggagtgccactggaaagatgatgtgaaaatcatcccagaaactgagatctttcaaatccaggacacctccatcatttcactgtctatgccatcttcctttttcctcccaaattactttccagaatagttgccctcacccgcacctctcgccagcaggacacaaagagttccccatgttcaagtcaatgctgatgttttccaacttcaaaatgtctgacagtttgttgattatcttgacttaattggcatgtctctgattgctaatgagattgagcatctttccatatcctgacaagcatttggctttcccccctgcaaatttcctactcatgtcctttgcctgtagttctattggtttcctgcctttttatattatagaagctaatcctttcttggttgtgtgacttacaaataccttctcccagggtattagtgctggctgtggtgtccagggtaggtactcactgcccctaccggaaggaggattacacacacacctgacccattgatgagaagcttgaccatgtgacttgctttggtcattaaaatgtaagcggaagtgatgtgattttttttttttaaggaaaagtgttaagggccattttataaaaccaccgtgtaatttaattcagagagagcctgctctttcagcctgaatcctggaatagagacccatggagcagacccatggccaggccacagccacctcagcagaactcagcctttattaccataagccatggaaattttggtgttttttgttaccacagagaagctgaacaattgaaagacatactggaagtgaggtgccaacactaataaaacacatgataggatttagggctgagtagcaggtggcaagaaaattgatattaaaggctttttatgtagtggtgaagcatttgaaaaaaactattgcctgtgataactagaaggcaaaaaatgtaactaataaacttctggtttcagcaaagaaatgggaaaacagactgtggataacattggatatttgctaatggctgcatttgacaagacgcagtaagaaagcaataagctcacaaaagaaatggccattttgcaagaggaattcaaagagagttcagagaggccataaatttcaggacttgcagggttagaaaatggaactgtttctcatctccaattggcaaaagataaaactgagaagaccttgagctatgaagtccaattaagattcatccttggggcaaagataaagtcaagtagccttgtcagcccattgttagagctctaattgggcagaaagcgggagaggagatgaagtattgtaagtgaactaactccgccattcagaaaaggtggaaatatttgatgtcttaaaattagtaattccataaatagcaacataagcatagtattcagaaatatggaggtgtaattgtttcccactgctgtgtaacaaataccacaaacttagctgcttaaagcaacatgtgcttactacctcacagtttccatggtcagggacttggcatgggttaactggctctttgactcaggatcacatcaggctaaatcgaggggtcagccaggcctgtgatcccatctgacacttggggtcttcttccaaattcacttcttgttggcaaaatatagttcttttacagtggtagaactgaggccctcagctcccaggaactacccaccactccctgtcatgtggtcctctccacaaaatggcattttgttttctaaagactggtagagaggatctctgttgctttgaatatctctggcttcccctgtctcttatctctagaccttcttttttttttttttttttgagacagagtcttactctgttgcccaggctggagtgcagtggcatgatctcggctcactgcaacctctgtcccccaggttcaagtgactctcatgcctcagccccccaagtagctgggattacaggcacgtgccaccacgcccagctaatttttgtatttttagtagagacagggtttcaccatggtggccaggctagtcttgaacttctggcctgaagcaatccaccctccttggccccccaaagtgctgggattacaggcgtgagccaccacaccaaatctagagcctctagaccctgtttgaaagggctcatctgattaggtcaggcccactcaggacaacctctttcaattaacttaaagtcaactgattaggaaccttaattacctctgcaaaatccctttaccttttctatataatgtaacttcatcacaaaagtgatatcccaatcacattggcaagtcccacccacactcaaagagaggggattagacaggcatgtccaccatgtagaggaaatcctggggccatcttagaattctgtctaccatggaggcagtcacagaataaaaattttaaagtgttttcctctgaggagtgaaactggtaaaggggagaggcagaagaagagcataatctgtacgatttggtttttaaaaccacctacaaatatcatcttgatagaaatttatcttaattttaataaggtattttatatagaccacaaaaaatagcatgagcaaagaaataaaaatgcactcaactttagaaagcaatcaaaacaaattttcccctacaaaacagactagctccatgaggcaagtaaaaactttttttaaatttctgattcatatttcaaaaacaggaaaagatacattctttaatcaaatgaaatgattctacatcagaaatattggtttcagatttaaaattacttgcaataaatttaaaatgcaacacagttaagaacagaagattagacactgtgatgaaccaaataagtcatttagaagattggtgtgggaaattataaaactcaggatatcagataaagagataagatttaccttaaatctacatataaaggaatctattgaatgaaagaacaaaacaaagtgcaaaatataatatgttatatcgcatggcaaaggtgaattggtgttgcagatgcaattaaggttgctacccagctgacttcaaaacagagaaattaacctggattatcctggtgggccaaatgtaatcgcaaaagtccttaaaagcagaagagggaggcagaagagggaggcagaagaggaaaatccagagagaagcatcagagaaatgcagagagcaaaaggaactcagcctgatttttctggctttgaagatagaggaaggggccatgaagcagggaatgtgagcagcatctagaagctggaaaaagcaatgagacagctcctctagagcctctggaaaggaatgcagcccttccaagaccttgaccttaacccacgaagatctgtgttgaactctaatggccagaattgtaaaataataagtttgcattgttttaagccactaagcttatgataattgatcacagcagcaatagaaaatataagggttaaacatattcaggtgattgacagttttatatttaaaggcaaagacaaagtcttacacccatttacttggggaaaaataatgacgcctacaaatgaaaagtgaaatcaggctggcattggatttatctcccatagcactcatggcagaggaaaatgaaatgttatccggttatggggaaggagaagtgaattatgatccaaaaatattaagtccaaaccatttgaagttagaagcaacaaaaagacactctcaggcatgcaggaaaagtataaagattacctatatattttctcagatttaaacaaatacacagagggaataatccagtcatccaataagtaagtaaaaatgcattcacttattcaacaaatatttattgggaacctctttctcaaaaaatagtattcagggatacagcagcagagatgtcaactgtctcagtaagatcacacaggtaaaatctcagttctcatggagtttatatgctaggtgggagagacaatctattaacaggcaaacgaataaacaaataatacaatatcagtttgtgataactgctaaaaaaaaaaagtgaaacaagacaagagtgacaagcctggaggaaaaatatttttgataggagtttcttagagtgtctttcaatgacatgattcttaagcagagaacttaagccactgaggaaataagccatataaaatgtagaataaaaaaattccagtgaagcaacaaaatctttgaggctgaaacaagcttactatgtttaatggagagcaaaatgttctatacgactgcttgggcttcctcactgtatgactgctaggttctaagaccaagcatcccaagagaaccatgtggacaccatattgccttttatagcctaaccttgaaattacatagtcttctgctgttgtcatgaatccacccacatttaagggggagggaacatacacccagttctgcataggagaagtgtcaaggacctactgtaaaaaaatcatgaggaacaggagctaattttggccatttggggaaaatacagttcgccacagcataccgaaacaaaatgacatatcaaggccaaaaaataaagcaatgagcaaagacatcacagaaaactataattaaaaaaatagtaaaagagatgatatggttgaaatagaatacatgaaaaaatttataattggacaaggaaagtccatttatatcaatgaaaggcaaaccttgcaataaaattgttggtttttgctgtataaccaaccatgccaaaatttagtagcttaaacaatagccatttatttagctcagtattctatgggttggcaatttgagttgagctcaactgggcagtcgtcatcacctcagctgggctcgttcttcatgtgtgatcagctgccatgactctgcaactgtggttggatgactaggccaacagggccagtggtggaaatgtggccacatggatctcatcatccagcctgctggccagtgcttgcctacccagccgctgcagtaggagtcccaagagcaatgaaagagcaagctccactaacaggtgcttttcaagcctatgcttctatcgtgtctgcacccatgaatgtttacaagttaagtaacttagcatcaaaataaaccactaaagctaacaaaagcacaagaagaaactgataaaaatcacaatgatagcttcatcttgagttcttaatctttagacaataagcaaataaagaattatggttcaaacaaataattaagtcaacaaatatccatttttttctgttaagaatatgcatcatttttcaacgtccttggaacatttacaaaagttgatcatacctttaggccttaaaagaaaatttttaaaggatgttagggggtttagaaaaaaagaaaatcttaataaatctaaaaaaattgaagttacataggccatattctgtctaaatgcaataaaactagaaattaacaaaattataagcaaaaaaattcaaatcattaggaaatgaaaatgccttcctagatatcttttgggtcctaattatggatgatttagaaaataaaataatcacaaaattatatgtcaaaaactatgaaatgctttatgttagggatcagcaaacttttccagtaaaggaagtacatattttagacttgtggaccataagaactgtcacactacccaattcatactgtgattatgtagaagtacacatacacaatacacaacacataaaggaatgggtgtagatgtgttccaataaaactttatttatcaaaacaggcagcaggctggatttgacccatagtcttggttttccaacctctacttatataatattaatcaagtgttaagcacttacaaatttctaactttacatgtgtttattactaaaaaaggaataaaaatcaatgaaatattaatggactctagaagctagaaaaaagtcatcagtagcaaaataaagaaagcaagaattaaaaaataatgaagtaaaacataaattaataaaataaaagatagaaaaataatgacattaataaataactccgatatttgaaaataccaataaaataaacaaaatcaaaacaaagcaaatcaagaaacatgaggggaaaagcacaaatacatatcattcagtattggaaaggaatagcaatgacagatgcagagaatttttaaaatcataagctatcaactaacactaaaaacaactgtattgtaataaatgtttaactctcaatgaagtagttaattgtctagacatgtcctattgactaaaattgcctcctaaaaagggagcaaatctgaacagatgaagcaagcataagaaaatggctagggggagaactcagcacaagatggccaaataggaacagctctggtctgcagctcccagcgagaccaacgcagaaggcgggtgatttctgcatttccaactgaggtacccagttcatctcattcggactggttagacagtgggtgcagcccatggagggcaagcagacgcagggcagggtgtcacctcacccaggaagtgcaaggggtcagggaactccctaccctagccaagggaagccacgaaggactgtgcagtgagggacggtgctatctagcccagatactacacttttcccacagtttttgcaaccagcagaccagaagactccctcaggtgcctacaccaccagggccctgggtttcaagcacaaaactgggcggtcatttgggcagacaccaagctagctgcaggagttccttttcacaccccagtggcacctggaaccccagcgagacagaactgttcactcctgtggaaaggaagctgaagccaaggagccaagtggtcttactcagcaggtcccacccccacagagaccagcaagctaagaccaactggaatgtaactctcgctgccagcacagcagtctaaagttgacctgggaccaccattactgaggcttgagtaggcggtttcaccctcacagtgtaaacaaatccacccacccagaaggacttgaactcagctctgggcccagaggacctaatagacatctacagaactctccaacccaaatcaacagaatatacattcttctcagcaccacatagcatttattctaaaattgaccacataattggaagtaaaacactcctcagcaaatgtaaaagaacagaaatcataacaatcaatgtaatcaaattagaactcagaattaagaaactcactcaaaaccacacgactacatggaaactgaacaacctgctcctgaatgactactgggtacataacaaaattaaggcagaaataaataagttctttgaaaccaatgagaacaaagacacaatgtaccagagtctctgggacacagctaaagcagtgtttagagggaaaattatagcactaaatgcccacatgagaaagcgggaaagatctaaaattgacacccaaacatcacaattaaaagaactagagaagcatgagcaaacaaattcgaaagctagcagaaggcaagaaataactaagatcagagcagaactgaagagacacgaaaacccttcaaaaaaatcaataaatccggttttttgaaaagattaacaaaatagatagaccactagccagactgataaagaagaaaagagagaagaatcaaatagacacaataaaaaattgataaagaggatatcatcactacaccagagtaatacaaactaccatcagagaatactataaatacctctatgcaaataaaccagaaaatctagaagaaatggataaattcctggacacatacaccctcccaagactaaaccgggaagaaatcaaatccctgaatagaccaataacaagttctgaaattgaggcagtaattcatagcctaccaaccaataaaagcccaggactagagggattcacagccaaattataccagaggtacaaagaagagctggtaccattccttctgaaactattccaaacaatagaaaaagagggactcgtccctaactcattttatgaggccagcatcatcctgataccaaaacctggcagagacacaacaaaaaaggaaaatttcaggccaatatccctgatgaacatcaatgcgaaagtcctcaataaaatactggcaaactgaatccagcagcacatcaaaaatcttatccaccacaatcaagttggcttcatccctgggatgcaaggctggttcaacatacgcacatcaataaacataatccatcacctaaacagaaccaactacaaaaaccacatgattacctcagtagatgcagaaaaggccttcaataaaattcaacacctcttcatgctaaaaaacactcaataaactgggtattgatggaacgtatctcaaaataataagagctatttatgacaaacccacagccaatatcatactgaatgggcaaaagctggaagcattccctgtgcaaaccagcacaagacaaggatgccctctctcaccattcctattcaacatagtatcggaagttctggccagggcaatcaggcaagagaaagaaataaagggcgttcaaataggaagagaggaagtcaaattatttctgtttgcagatgacatgattgtatatttagaaaaccccatcgtctcaccccaaaaactccttatgctgataaggaacttcagccaagtctcagcatacaaaatcaatgtgcaaaaatcacgagcattcctatacaccaataatagataaacagagagccaaattgtgagtgaacgcccattcataattgttacaaagaggataaaatacctaggaatccaacttacaagggttgtgaaggaactcttcaaggagaactacaaaccactactcagggaaataagagaggacacaagcaaatggaaaaacattccatgctcatggacaggaagaatcaatatcatgaaaatggccatattgcccaaagtaatatatagactcaatgctattcctatcaagctaccattgactttcttcacagaattagaaaaaactaccttaaatttcatatggaaccaaaaaagagcccatatagccaagaaaaccctaagcaaaaagaacaaagctggaggcatcacactacctgacttcaaactatactacaaggctacagtaacaaaaccagcatggtactggtaccaaaacagagatatcaaccaatggaacagaactgatgcctcagaaataacactacacatctacaaccatctaatctttgacaaacctgacaaaaacaagcaatgggggaaaggattccctatttaataaatggtgttgggaaaactggctagccatatgcagaaaactgaaactggaccccttccttacaccttacacaaaaattaactcaagatggagtaaagacttaaacgtaagacctaaaaccataaaaaccctagaagaaaatctaggcaataacattcaggacataggcattggcaaagacttcatgactaaaacaccaaagcaatggcaacaaaagtcaaaattgacaaatgggatctatttaaactaaacagtttttgcacagcaaaagaaactatcatcaaagtgaacaggcaacctacagaatgggagaaaaattttgcaatctacccatctgacaaagggctaatatccagaatttacaaagaacttaaataaatttacaagaaaaaaacaaccccatcaaaaagtgggtgaaggatatgaacagacacttctctaaagaagatatttatgtggccaacaaacatataaaaaaactcatcatcactggtcatttgagaaatgcaaatcaaaaccacaatgagataccatctcatgccagttaaaatggcaatcatgaaaaagtcaggaaccaacagatgatgtggagaaacaggaatgcttttacacttttggtgagagtgtaaattagttcaaccactgtggaagacagtgtggtgattcctcaaggatctagaaccagaaatatcatgacccaggaaccccattacagggtatacaaccaaaggattataaatcattctactataaagacacatgcacacttatgtttattgcaacactgtttacaatagcaaagacttggaaccaactcaaatgcccatcaatgatagactggataaagaaaatatggcacatatacaccatggaatactatgcagccataaaaaagaattagttcatgtcctttacagggacatggatgaagctggaaaccatcattctcagaaaactaacaaaggaacaaaaaaccaaacaccacatgttctcactcataagtgggagttaaacaatgagaatacatggacagagggaggggaacatcacacaccagggcctgtcggggggtggggggcaaggggagggatagcattaggagaaatacctgatgtacgtgaggggttgttgggtgcagcaaaccaccatggcacatgtataaacctgtaacaaacctgcacattttgcatatgtatctcagaacttacagtataattttaaaaatatgaaaaagaaaaaacaaaaaagaaaaaaagagaatgactaacatttgttcagcgcttgcaagtatcaggtattctctggctaactgaataccttgtattgtcacaatctgtccaacaaccttatgctgtgggcctattattatgcctatttgttcagataagaacacagatatttataaagattaagaagcttcctgtaatctagtaactgaagttggcacactttgacccaagcagtctaatgactctggaacctttatggcttagcattgcagaagaaattgaacagggtatcaaagagcaaccaccaaaatagatagtgggacaacatgatatccccagtgagctccctcaaactcttgagcaactgataattcctatgtaatttaaattatttcaggggaaaaaaaaaagataaaaagaagaaagtgttccattttattttaagaagcttaagccatctaaaattaaaacttgacaaagataactgcaaacttatctcacaaatatagacgcaaaaatcttcattatatcaaatctagaaatatattaaaataataacatgtcctgaacatgccagtttataataggaatgtatagatggtttatagtgagaattaaattctgcacataattcattatattaacagatcaagggaagaaaattattctcctcaataaatgttaatgtaatctgctttctgattttttaaaaactttagaaaaataggaatagaccaataattctttaacatgttagatatcttttaaccaacactcagcataatgtttaccattaaaatattggaacagtatttcccaaactatattttgttgacgataagctgcaaaaggtagaaattcttgttctatctcttgaaggaatgtgtttccataaatacaaaaaaaatactacatattgtattctcatcttagaaattcaaaatatacctcactggattaagtctagaagaatagcaaaaatagcaagtaaattctgaaaaagaagacaagaaaaacatattataaatccacagtgttaaaatactgtggttatagtaactgaaggaatagacataataaaacattgcaaaaaaagtaaatatgagattttaaaatacaataaatagtccatttcaaaacaaggaacagaattcagattattccataaaagataataagacagctagaaaaaaaatatatatatatatatatctcagacctcaagttcatattttactaaaaaggtaaagttttcatggcccaaagagttctatatcaaaaatgaaattataaagatggtttaaaaaacatagatggacttcaggtatgaacatggctatcgaagtctatatatctctctcctcctagaaatcatacaagcaacaaaaagcattaccaaaaaatgcagaagcttcattctcagtgaaacttggaaaaaaggataattgaaagactttaaatcacaggtaatgactgagaaatgcagctgaaatagaatagaaaccacatagaaggaaataaaaagaaaagtgcaaagagtaaagaaaagccataatgctatcaggactcaaaaaatgctgcacaaatccatctccttaagcaagagccacactttagtataataggtatgtcccttgtctacaacagtggttgtgacatataggagatgagcagagccagtggcaaaaaaaaaacctctttgatcaggtttggttgaaagaagcagagaaaggtctacatgaagaaattgttttaagccctattcaatggaagcagtctgtctctgaaaccattcccaaaaagggacctctaagctagtggaggaaaatatgatcattcaacaatgaccaataaaatgaattagcacagcattgatataaggaagatctagtgaataaggggtaaaagagccacaaaatttatcattaggtaagaacacttgccagaaaaatgttgccacagagcagataaaaattttaactaaatattttatcatgaattttaattgattaaatgaggccattatctttgtaaaggaagaacagaaatacaggaacctagaaaagatgtgattattcaacaaaagagataaaacatgagttaatgatatatactccaagaaagaataaatgaataaatcgtggaagaagcaaaaatgagtctagatactctggaaacacactaagaaacctagagaatattaaggacaaccatgaacatcataaaacaaaattcaagaaagcatttctattaaagaaaaaatgtagatctagaacacaggtaaaggaggtgcaatgtatatataattggagcccctgaagaaacccaaacaatgcagtgaagcaaatatttaatgacattattcatgaaccttcaatgaaataaaaaagaatataatctgcatgattgaaagcacgcactgtggaccaggatttttaaaaaaagacctagaacagttaacatgaagactcaatcatggtagactttccagacttttttttttttttttttttttttgagacagagtctcgcttagtcaccccggctggagtgcagtggtgcgatctcagctcactgcaagctccgcctcctgggttcacaccattctcctgcctcagcctcccgagtagctgggactacaggcacccgccaccatgcctggctaattttttgtatttttagaagagacggggtttcaccacattagccgggatggtcttgatctcctgacctcgtgatctgcccacctcggcctcccaaacagctgggaatactggcatgagccactgtgcctggcctccagactttaaagaaaaatattctgaacatagaaatcaatctggctccagatttatccactgttaaacaccaaaagacagtgacacagcatctaaaagattctcctggaaaagtatgatctgtccttccagtgtaaaggctctggttatttttaattgcaagaaactagggaatattggtatcatgagtgcttcttaagaagccactagaggataaactttagccaaccagaagataattaggaaaaccacaagcagaaaatgcagtggtgagcgctggatgggtttaattgtgaattaagagcaaaacaaatgtgcggactagatgatagagtagaagtaaatgttatatgccatgacattgtaaaaatggtatgaaaataaaacttaggagaggaagggaatgagaaggtgaagggcagagtaagtttgccagttacctcacttatgagacaacaggcgtcattcacagctgacaaatcaagtggtagaggtataaacacatctccctttggaagatcaactctaagaccaacaggcattattgactaaaactgggtggagagccaggggagaaaggagcaaatgcattaacttcatcattgttttattaagaggaacaaatacacattgtgtcaaaaataggggatcaagggtatgtttttttctagatggggtctcactgtcacccaggttggagtgcagtggcatgatctcggctcactgcaaccttcgcctcccaggctcaagggatcctcccacctcagcctcttgagaagctaggaccacaggtgcaggccaccaagcccagctaattttttgtgttttttgtagagacaggatttcgccatgttacccaggctggtctcaaacttctgagctcaggtgattcacccctcttggcctcttaaagtggatatttatttatttatttatttatttatttagagatagagtctcgctctgtcgcccaggctggagtgcaatggcacaatcttggctcactgcaacctccgccttctgggtttaagcgattctcctacctcagcctccctagtagctgggactacaggcacgcaccacctcacccagctaatttttgtatttttagtagagacagggtttcaccatgttagccaggctggtctcaaactcctgacctcaggtgatccactctccttggcctcccaaaatgctgagattacaggcgtgagccaccgtgcccggccagcatatttattttaagtgaaattataaaagtaaccattaccataaaaatacaaacctttctaaacttcagaaaaagtttcaaaggaaacagaccacctggtgactgactttatttgaagacatacaaattaaaaaatatcaagtaaaagaatatggaaaaagtaagatcaaaagcatctaccactaatgaaggtcaatgagcttcttcaactcctttcaacttatcttcgatgaatgaaaggatggaagaaagggaggaaagaagggctaatgggagggaggagaggggagactggatgacaaagcaaaacccagctgtaggctgtgcgtggcagccattccaaaaacagaataattcacaaggatttgtaaaagatttcaaaactcaaatactaagaaaaaagagcagaggttgtgatattaacatcactcaagacagactgcagatgacaaggcattgaaaaaaaaacaaaaatgcccctttattagcttaaatggtgcaatttcacaacaaatatataaagctcttaatatctgtggacctccctctgtccttgatatgtaaaatggacaaaaaataaattgcagagtacctaaatagcataattaataaaggaagtctggtttatagatacagaaatacatacatgcatacattcatacacacaccctgaaaatttaaaaaaacgccttcagctcaagtgccaatgaaagtggataaaaattggacatggttaggcctgtcaggcctgtgagcccaagctaaaccatcatatcccctgtgacctgcatgaatacatccagatggcctgaagcaagtgaagaatcacaaaagaagtgaaaatggccggttcctgccttaactgatgacattccaccattgtgatttgtttccgccccacgttaactgagcaattaaccttgtgaagttccttctcctggctcagaagctcccccactgagcaccttgtgacccccgcccctgccaacaagagaacaaccccctttgactgtaatgttccactacccacccaaatcctacaaaacggccccaccccatctcccttcgctgactctcttttcggactcagcccacctgcacccaggtgaaataaacagccttgttgctcacacaaagcctgtttggtggtctcttcacacggatgcgcgtgacaaggccaaaaacaaaatctccagaaagtaaaaacagggaagaaaattttctatggtcacgatgctacaaaagtagaaactgaaaatcaaattgaaataccaaaaggcccttccacctgggagggaaaaacacacacacacgcttttaaacaatcctgactcaaagggactaaacagaactgcagaatgcccagaaaaccagaatgaagtggtcacatgttaagaatctagaggaaaaagctaagcaatgctcagcataaaacacttaaattctattgattaagaagagaagaaaaacaaagaatgaattgaaacaaatgaattaagcatccaactcaaaaaggttaggaagagaagagcagagcaaacaaaagaaaagctaaatggagaattattttaaaagcagaaatgagcaagttagaagtcagaaaaacagtggaaaataaatctgaaggtttttttcttttggttgaataactttttatagtagtgtctgcatttaaatacctgcacaatgtcaagtggtcatgcagtagggaggagaaggagaattctgaatagagggaattgactattttaggcggaagttcccggggcctaaccagcgggggccaggaggacaaagagaggactgaattgctttgtataataaagtgagagggctctgtggggagcctgagactgaggggtaagggttctaaagaggaaagaacgcaggaaatatgagaagtggagaaagagagagagcaacataaagggaggttgaggaagatgaagtgcctgggcgggatccagtctctcctgcactttgcgtccactctgtggtttacatgtccgttacacttggagtgcgtcttcagtaactccctatcacaggaaagtcaatcgtgttcttgcatgtctgaaaatgtctttaagtgtcctgcaaacttgatgatattttaggcaaagaattctagtgtcattctttttttttttttttttttttgagacagagtctcacactgtcaccccaggctggagtgcaatggcgcaatcttggctcactgcaaccaccgcctcctgggctcaagcgattctcctgccccagcctcccgagtagctgggatcacagacgcccaccaccatgcccggctaattttttgtatttttagtagagacagggtttcactatgttggccaggccagtctcaaactcctgacctcatgatccgcccgcttctgcctcccaaagtgttgggattataggcgtgagccaccacgcccggcctctagtgtaattctagtgtgaaatcattttccctcaggattttcaaggtatgactccatttgtcttcatatcccgcactgagtggttaaaaagaaaacagcgatcaacatgcactaaaatggatagctctccaaggcacaacgttgaatgaaaactacaactcttcaagtaaattatgaagagtgataccttttatatcaaaggaatctggagggggactcaccagtgcttcactgcggggaggggaaggggcgctggaattggggggcctggtcaaggtaggcaacagacctatggattgattatctatgtacttttcagtttgtcttatcaatgaaacttccacccaccagatgctcaataagcacacaattctgtgttcttatagcttaccatttttaccacctttatatttaacttttaaatacaactggaatttacttagttacatagtatttagttatataggacggtttacaagaatattttttcctatttccttttttcctattccctatttcttttcctatttcccttaccatttgttcctacaccatttattgaatattccttcccttccctactgatttaaagtgtctccttgaggcatgtatcaatttgaaaaatatgtagtgtagaacccaggtgtcctaattcccagcctggtgatcatttcactccatcactgagtagttttttaaattatttttcttttagacattgtctttttcttaatttttaaaacatttcagatttctaacactctgttttgttcttggatctgactctagttggatttttaccacctgcatttgttctatttttctagggtttgagtaaggggttggaggaacacttaggtttgttaattcattcactcagcaagcgtggctttagcagcagctatgttccatgtactgttcccagcactggggatattaggacatgagggcaaggggttgcctcttatgtttttcttttgtcttttgtttcaagctatttccccaagttttttcagtttaattattcacttcatctgccctatggccacagttccatggactggtagcaagtgaccagtacctgctctttgggatcatccatagctttgaaaactattgtctttctttggccaccccacatccctagcaagctacttttcccaggccttacaaagaccaaacctactccgctcctgtgacaggaatgcgtttcactctgtagaagtgggggttcaagatgctggcatctgactatgaacccttttccacctctacttctgctaaaaaacaaaaggactagatcataagatctgctgcgcactttccagaggaaaaaaaaatgttctttgtagcatagagaaccgaccaggaagcattgtgagaccttttccagtcagttctgatttattatacaaactccaggcctccaagagcaccaggtttcatggaactctctgcggtattttgaatccataagccaatgaatagatattatatctaaaccacaggaagcatctacttatctgtggtaagtgttgcgatgtccttcatttaataaaccacttagagacaccgtgtgactgaagtgaggaggactctgtattggagtttaacttgctcaggtgagctaaactcagtggaaattaaagagagatggtattttgtgtttggatccatgacaaatctaaaaaaactaaaataaaagtagtatatagtcatgatacttctgtgagcagcaggtgatcatctttactactttgactgcatgcatgactgtcataggaataatgtttcatactaaggtgcagatactccacataaaaagagtgattttgaacctgaaacagccctcaagaagacagtttcccaagtgggatgccatagcacagtggagtttgtcaaacaagttaaccccctccgccctcaacaccagagccaagacctctcacctatcaccatggacgccctcctctcagtacaaatgctgccatttcctgacgatgccatgacgcagaagaaaagaagaaaacaaaaccataaagcactgctacagtataacttaagccaaggacattatggtgtcaattttatagaaaaatcgtttagcaaattgtcaaagttgtggacattccaaatatgcaattgattttcctattttccttgtagtaggtatgctgagaagaaaagtctccagaaaggaaatgcttgcttaaaagtgagcacctggtataccgttagtgggaccgtaaaatagcacagctgctgtggaaaaagtttggccattcctcaaaaagtgaaatataaaattaccatatgacccgtcaattccactcctaagtatataccccaaaaagtgaaaactagcactcagatatatatatacatacatatatatatatatatatgcatattcaaagcaatgcaattcacaatagccaaaaggtggaaacagcccaaatgtccaccagcagattaacagataagcaaattgtggtatagtcatacagtggaatactattcagccataaaaaaggaataaagtttggatatatgctacaatgtggctgaacctcaaaaatgttatgctaagtgaaagaaacataatacaaaatgtcacatattgtagaattccatttacatgaatgtccggaatacataaatgcatagagaagaaatgcagcttgctggttgccagggcctgaaggaagcaggcgaagcaactgcttcaggggtacaggcctccctttttgggtgatgagaatgctttggaactaggtagaaatggtgattacacagtgttgcaaatgtactcattgcaagtgaaactgttcactttaaaatggctaaatttttattatgtgattaaacattaaataatttttaaaacagatgagaaaagaactgtaagcaaaaatataaagtaaaacagctagggcaccagaccctgagcataacatcagttaaatgataagaacctacagtctgctctttcacacttttgtgccttctcttttctgcagaagctttgcagagtttgatttctgcaaaataccacaccttacatgcatgccacaatgctgtactcctcattgcttctgagtcactgatagatgaggaaatctgtcctcaaagagagagctggaaaggaaaggcagaggggaaaaataaaccttacatccttatgcctgcatagaggacatcgcattcatgtttaacaaaaacagaaaacaaaacaaaaaaaacagacagcaatatgaagacagaagtatgaagagaagttttgcagcatgaagataattccaggctggtgtgatcatgggagcattgtcatttctggagacttgacatttccaaccggcaatcgtttaaaatcatgtacatgccatttgcaactgaacatgctagtgggtaatttgttattttgagatggaaaacaaaggcacacagaggttctcatgacttgctgaaacaagagaccaagaattagaacccagtgccccaagtgatgagttctgggccctctgcctctagcaggggctgtcttgttggtgatttttctagagctggtggagttcggcctcagcacagaacctgagtgaagaagctgtccaaatgggtttctcctttccctacctgcaggcttacccttcatctgacccatcctgtaaactgatactaagacagcaattcttaaatacctcttccaatgtgtcaggtacctaccaggacttcccacatcctaccccactccgtcacttcttcctctgtcccagctcctcatagccaaagtcacttcccctaccccggtcatctaccctctgtttgctcagtccatggggaatggcctcctacacctcatcctagactttggctctgcacccttcccacatctctgcccttccaaaccctcctcctccccacggcatgaaacacagggctaagaactccagcaaatacttaagtcagctgcttgtctcttaggattgaggaaccattggcatctcagcttctgcgagcccacacctcctttgaaataagcctgagagctcagagcttcaaatccaaaaccaacctgttttcagccacactgctcaccaccttgggggtgcaaaatgagacctcccaggccacctgagaagaacaagaagcttcttctcttgtaagctgcccccacatagcaacccctcttttaagagggtgaattagtttccagggctgctgtaacaaatgaccacaaactgagtggcttaaaacaacagaagtgttctctctcacagttctggggaccggaagtccaaactgaaggtgtccgcagggccgtgttccctctgaaggccatagcgagtctcttgcctgcctccccgtgacctccggtgggtgcctgcagcccaagcattccgtggctcctagctgcagctctccactctccacgtccatcgtcacgcagccttctttcccccatcgctgtgtctctgttctctcttcttaggagaacatcagccaccgggtcagggcccaccctcacccagtacgccctcatcttaactgttaggttggtgcaaaagtaatggcggcttttgccgttgtacttatatctgcatgactctatttccaaataaggtcaccttcagaggctccaaatggacctggattctagggggacactatccaacccaataccagagggaaggtggggagtgggaaagatttggaattagcattgtaaggaggatcattccagtttctgttactccatctcctcagctcccctgaaggactcaagtgccagctcagcctttgccatcttgtcgctccctctctaggccgcccccagtcccagatgggctggctgtctacaggcaccagctgcctttccatcctgaaggaattcctcagccctggcctgcctcacctgagtgtaaagtttgcagagacagatattaaatcaggttttcacctggttcattacattctgatgattttgaactactgggattttcaatctgaaagaaaacattttgatacggcaatgcccacaggacagctctaggatgagctgttaaaggacatttagtgcgtcctgggaagcagcagagtgtgaggctatgtacagacgcgccacttaaaacccaccagtcgactcgctagacggcccaaagggagatgtagttatgtggaagagctttaatcagaatttaggcataaaatgaaaagctccaaaggaaagcaggtctttcagtctctgcacggcatcctacagattcagcccagctccttttaatgcaaagtttaccaagtcaagaaggaacaggcagcccagagacactgggtacaaatcatggctttgccaaccttgttcctggcattgagctttgactgggctggaccatgctgtttcagagaacccagctctttctttttatttatttttcttaataggaagggctacttgcatccttcagtctacgaactgttctggagctcagactcgccattgccaatgtgacacatctatacgctcatctcttcccgagtctgcagtcagccttgtgtcagaagagtcctgggtctgacttcctttttgtctcttaaagcccttggcagagttccccacaaagtgccttgctctcccgggggttcagaaagttgagtgcaatgagcagaagcaatgtgatgtgttcacgggattggatttgtatacataagacaatattcagcacacactgcattcatatatagtaacgagtaatgcctattgggcagcagaaggggatgctggggaaaagggagcatgtcctctgagacccaggcttcatctcctgacattggcaaaccagctgtgctgtgcagccttcagctgtttttcagcctccaggacgtctctaccagaggttccgaggggcgtctctcgtgacgtgtctctagtgacaggttctagacataagagagaaagcatgatagaattttcttactaggccattttgcattttgcagatgtggatgcctggtaagagccagaggaaaaagccccaggtcagattgtcactgtgagccaacctggatggaaagggagctaaactatgaagccacatgagacgggagctcagagggcccagagcagaagtgaggtgagtcggacccctactgtgcctgcacgtcccccgcccccacttcccccactcatatgccaaggtcctaaccctagtatctcgaaagtggccttatttggggataagctcttcacagaggtcatcaagttaaggtgaggccattagggtggccctcatccaagatatcctgtgtctttataaaagggggagatttggacacagagacaggcacaaatagagaaccacgtgaagattcagggggaaaatggtcatcaacacgctaagggcaaaggcctggaacagagcctcccctcacagcctcagacggaagcaaccctgtcagcatctcgatctcagactttcagtttccagaactgtgagacgatacacttttgtttaatccacactgacagttaagccgtaaccttgttacagcaactgccgcaaacgaatatgcctgcagtgaccggtcctgtatgcctgccctgctttgcaggtacatgggggcattgaaaatggaatccatgcccaaaccagcctcaaccagtcccctttggtcaggtcgtggtgctgtcagctttcatcagtgacactcatttccatgacattctagcttaacagatatggtgcaccagaaagctgcctagcaatttcacaatatcaaccaaattattttaacatggccatcttttcattcagcaattgcgtgtccaaggatgtagagaatttcccccaagaaatacagacaagtcctcagagatgcatataaggatgtttgcaacagcatttttctgttcctcattgattgttttcatattttgtttgaaaataattcaaatttacaaaaagttgcagaataaaaatagtaaatgcttgtatgccattgacccagagtttctcattgtccacagtttgcttcatttatcaccttcatttatcaccctctctctctcaccctctctcaaccatttgaacaaagattgcttacctttcagccctttaattctaactatttcaatgtgtgtttcctaagaataaggatatcaccttacatcaccacaatacagtcaccaactacagtaaatttctcagtaaatcaggacatcccctcatcaaaacagtgtttttattcaatctgccttccacaatccaattttatcaactgacccaaaaacgtccttttttttctccaccacaaaatccagtccaggctcaggcattgcatttagatgtcatgattctttcatttcctttagtctacaacatttccacagcctttccttgtcttttatgacattgacgctattgaagaacacaatttatttttaatagactagccctcatttgaggtttgttgcatgtctgctcgtggctgggttcaggttactccagttcaaggtggaaaaccccacaaatgatgctctgtccttcccagggtgtcccatctggaggtccaggatagccacctactcctcactggtgatgtcaatttttatcactcagtcaagtattgtccaattgctcaattgtgtaattgctactttttcccttgtaaataacacgcagtctgtagggagacactgtaagaccctgtaaatatcttgcttcccttaggtttagcacacatggatgacttttgcctgagccaatcttgactctaatgcctatgaaacgatagttttccagctccagcatgccctctagagtgactgccttactcagcatcctactacaaacctcactactcacacgtgtgccagaggacagagacacaccctgcagggcttcctgagcctggcctggtaaggaagtttccagagctttcgcagtcacgacatctcctctatgacaagagacaagttcctgcccttgcattacttgccacgaagaaaacgacacaatctttgcaggctgctttgaattttagaggcaagacgaaccacatttgaaaatgctgctttaactgtataacccaaaaggtaaccctgtcaacccagaacgtcttttccctgcccccagcacttctatcagactcaccattagtggagttacagaatgcctccatgcctgaaccagtaccctggtatcccgcgtaatatcatctccaaccagggaacattttacaataaaggaaatgattccatgggctcaggcctacagaattccctgggtttgctacatgcctaataccagaagccactggctggacagaatgatgaatggtctgctgaaagcctggttatagtaccagctggaagaaaacattcattccgtctatgaagtaacgggcaaaatgcccgccttaaagtttagggattaaaccaatggtcaacctatggtgtcatcatccctcatagccaggagcacaggccatggaaacaaggggtggaggtggaagcaccccctcactattacgtgtagtaacgcactggagaagtttgcttcccatgcctagaacgttggctttggtgggtgtggaggttgccttagtccattcacactgctaaaacaaaatagcataaactgatagcttacaaatgacagaaattcatttcccaatagttctggcagctgggaagtccaagatcacagcagattccgtgtctggtgagggcccatgttctggttcatagacggcgccctctcgctgtgtctgcacatggtagaaggagtggggagccccctagggcctcttatataaggacaccaatcacatcacaagagctctgcccttatgacttcccaaatgccccacctcctaataccatggccttgggggttaggatttcaacatacaaatggggaagagagaacatagacattcagacaatagcagaggcccatgtccaaagcaggaaaacaggcatggttctgagtaactggaagtcaagatctccttgtgaggctgttttggcttccttgtgccaataaaccaaggaccagagtggggagtccagcggaaatttgggggaaggtaccaagaaggactgtttgaaacctagagaatccatggggttcctgctttgttctcccttgcctcatgttcctggtcaacagaaaactgcagaaaggtcaccacaatctcatgtcctgcaggaatgcagccgtgggtcacctcaccaggtaaagaatccatccagcatatggctggcaaaaggcaagggaactagggaaaggaatggctggtggaaaggagcgctgggcctctcaggacctcctgaccagctgtcaagcaggatcgtagcagctaggtgtatgtacccacttgattgtcactgcctcagtcctaaatccttatgtgaagggcataggcttggctgacctttcaggtttcaagtggaaacacaagtaaattaacatcactttgcaataagagtagttgatggcacttcatgcattccctgtgctggggacatgagctttttatccaaaagaacagaatagatgctgggggcaaaggggtgggctgggccagatgccttctgtttgctcttccaggtttgtctcctcctgctgcaccttggcctcggccccaggaggctggattgctcacactctatgacaggcccccagaaagtctgtcctctagttgggtttgctcagcgggagccccagcagcagaggaaagggagtgaagtcagggtatttcttctctggttcctccctgaggtcacctcgggctggtatgtcactgttcctccctaggtggcttgctccaaccactgtttcttccgggtttcagtgacctctcctatccttcagcccaggcaggaatggcttcactgtcacaaccctagttcctgcactgggctatggtttccttatacctgccacatctttgattattttctttataaataaagcctccttgatttatcctaagagagcacaccatctgttatcccttggcgccctaaccaatacacagagtttcaatagtgtgcccagggtcctgcaactgtgaagcagtagggacagcagtgacttgagaccaggctcccggccctgatgctcgttcctgccccagccccttggcccacccaggaggatcctgcaccttaaaggacaatccacctgtgctcacagctgccagctcccagcacccacatcctgtacatggggcaggcagaagggctacacacagaaggccccacacaacccctccacccacaggtatggaacagttgataaatgcccagtgtccaccccctcaggggggacaatacacattccctcagagagctgcagcaggatccatctccagccacccatgagggtgaccagcaggccctccactgttcacccccatttcccaactcttttcctcccctcttggtgtctcctgggagcacctccccacacactactcacacccaaacctttgtttcagcaattaaagacacccaaactgacatagcacccggcctgcactccctccttctgtgcaagccacctccctgagctactgagcactcaaaggcaagggtgtagccttcagagatggagaagaaatcattttcacattagaatggcacagccagccaaacggtcaatgaagggaaatagcaaaatggtacatcttctgagacacacagaatgtggttgacagggctgagcatggtggctcacgcctgtaatcccagagctttgggataccgagtctggcggatcacttgaggtcaagagttcaagaccagcctggccaatacggtgaaaccctgtctccaatttaaaaaattaaaaaaaaaaaaatccaaaacttagcccagcatggcggcacatgcctgtaatcccagatgcttgggaagctgaggcaggagaattgcctgaaccttagaggtggaagttgcagtgagctgggattgtgccactgcactcctgcctgggcaacagagagagactccatctcaaaaaaaaagggggatgtggtttacaggatagcagctcccaaagacatctatgctcgggacctgtgaatatgcaccttacgtggccaaaggggctttgctgctttggttagggttacaggagcccttaaaagcacaggacttccatgggctggaggacagaggctggacgcgtagagaggaactcgaccgctgttgctggccttgaagaccaaagaagggggtcaggagcagggaacatgggtggcttctgaatgctaagaacagctccccccaccccagccaacagccagcagggacacggggacatcagtcccacccctgcatggaaagaaattcggaactttaaggtaagaaatggatattgttgttctcactcttaggtgagagctaaacaaaggtacacatggacatacagagtggaataatagacaccagagactccaaaaggtgggagggggctaaaggatggaaaatgatctgttgggtacaatgtacactactcaggtgatggctacactaaaagcccagacttcaccactacacaatatatccgtgtaacaaaactgcacttctaccccctaaatctatttttttagaaatgaaaacagtttgtgatgcatctttaaaacaaataaatagatgttgttttaagctcctaagtttgtggtaaactgttatggtaaaaagaaaacgaatacacagaatgacaaaaatttatttccacatgccacatcttagaaaactgcctgaggatgcactctagcaaaaagagggagtaaacaaagaaagggggtggtgcaggggctagaaaatagtgtcctccactgaggacagtggagaccaaacacagatcccacaggggcgggagctctccagggcaaattggggaagcggggctgagcccaccaagggtacaggtagggatcagccctcagtctccagcagggccaagccagtctgtagaggggaacacatagaagagcagctgccttagtcagtgaccccaaaatactaaggtgggaagaaagccccagttgcctgctggtgatagcgggcagccagtggtgcctccatcatcactctcagtggaaggatggcgacttggcccaggccttagtggaagacttgtacctcaactgttttcatcttttctttgggtccagataatgaaacatctgtggcaagagagagaagagaaagagaaagagaaagagagagaagatgtgtatctcttgtgttgatgaaacacaagaattagatgtttaaatatattatttagagttacacagctaaagaaaagtggaactaaataagtgatgtcgttataggaggaggagaagcaggggtggggtgaatcctcatctatttcagcaggaagctagtagatggtgtttaaagttgataaatcaagagagagccacataagtgcattgtttacagacatggaggtaaccaccagatttaaaatgagacagttaaaagcagttttgtttcgagaactgaactgaggaggaagaatagagcaaaagcctgttatttttcactacatgcccctctgtactatttggttttctaatcccatgcatgaaatccttttatatatattgtttttacaaaagaagaaaaagagagagaagaagggagggagggagggacccctgcctgaacatgcatcaccaaagccagagccagcaggaggttgcaacaagctggaactgctcaggctgtgcccaaggagcccccagcactgctgccctcctgctggtgtggggcacattgctccagagatcagggtggggtcagctggcagcatgggagacaggctcaaggatggggaacagcctgggtcaggagagtatgatggtgttgaagctagccccagggggtctatcaaggcaggtgtagcaactgttccagacacttccagggtttggcctaagcctggacatctgtgtttgctaaggagattccatcatttgggggacaacttgaacagatcactcaaggaatgaaaactgggcatatgaccagctgactcttcctcctcttcttcccaatgtcctcagagaagtaaaataaagcccaaactctccagcagagtgcaaggtacttgttggaggaaaggaagagaaggctgctctttaggcgacttgtccatagcaaggccagctggggccacctgtgggagacctttgtccaacccagaatgaggtgtcagctggagcttagggtcatattgactccatataagggtcatacacagaatttgagggttcacaaaacacattgcatgcattacctgatctcgtgctcataagcaccctgcaagtatagaaggccaatataacttcctactgacaagtagggaaagctcaagctcacagagagtaagtaacgaagccaaagtcaactgtcctgagtagccgtggaccgagctccctgtgtccctgctggctgttggtcggggggattgttctttgcatttagaagcctcacacattccctgctcctgacccccttcaaggccagcagcagtgatcgagtccttctctatgcttccagtctctctgagctcccttctgcttgtgaaattctgctgcttttaagggctcctgtaaccaaactaggctcacatggaaaatccaggattctctcccacctcaggttttataactgcaacagcaaagtctctttggccacgtaaagtgcgtatttacagcttccaagaatcagagcgtggatgtctttgggggctgctatcttgtcaatcacattctgcgtgtctcagaatatctatcattttgccttttcccttagggaaaaaagaaggaactggaagatttgctgggcctgcctgggccacctggggccagctgttttctaaacaccagctccatgacaggcttcatccacagacatgaacaaacaggctctagggacagcggccccgcatctaacaagatgcccatgctggctgtgacctcctagacatgctcagcagcaaatgatttggagatgagagctggtttctgccatggataaaatgtaagtgctggtgggctagggaccatggtcagcctgcccctgggctcactctttcctttatatgcagagagaattgtttaagcccccataacccaaaagtgggcaccccccgcatctctcagggttctcggggcccccacaggtcttccagtccctgttttttctctttcctccttcatgagtctcatcatctttcatgcagatacccctggacttgcacctcttgctttccctgccacaaacacccacaatgtgcagagccttccccttcctttctccaaaagacagctcctcccaagtaataaaattgtactaaacactcagagtcatagtgagcagttacctcacagaagataaattaaacattagacatttccagttttataaggaagagtcattctcatttgaggaaataaattacaagccaaatttttttccaaatccctcaggccctgcattgcatttctcaacagtgctcaagacctgttctggtcactgtttctttctttctttctttctttttttgatatagagttttgctcttgttgcccaggctggagcgcaatggcacgatcttagctcactgcaacctccgcctcccgggttcaagcgattctcctgcctcagcatcctgagtagctaggattacaggcatgtgccaccaagcccagctaatttagtatttttagtagagacagggtttctccatgttggtcaggctggtctcgaactccctaccttaggtgatccgcccgcctcggccttccaaagggctgggattaccggcatgaaccaccacacctggccactggtcactgtttctatgtcacaaaccaacctaaactaagtggtaaaaaaaacattttattatgctcacagatgtgagggatcaggagttctgacagggtagagtggggccaacttccttcttgaagtcctcttctgggaggacttcaaggctcagtgtgatttaatagctggaggtaaagttatcgtgagacgtcttcactcatatgtctggtggtcttggctgattattgccggagattgttggtcatagcaccttcccatgtagtctctctacctgggcttcctcacaacatggctgctgggttctaagggcaagtgtccagagagaacttgacagaagtgcccggcatttttatgacttagccttgggagtcatacaaaggcactcccgctatgctccactgattgaggcaatcacgaaggtccatccagggtccaggggaagaggacacagactccacctcttgacagaagagccagtgggatgggagatatgactggggctcatctttggaaaatacaatatgccttacgaccacttcacatttccaacctcctctcctccatccttaccaggtgctcagaaaccccaaaagcttccctacttgatgttgcaaggcaatccattgctccctttgtctctcctggccatgccaggtgatatggtttggatctatgtccccacaaaatctcacgtggaattgtaatccccaatgttggaggtggggcctagttggaggtgattgtgtcatgggggtggtttctaatggcttagcaccattccccgagtgctgttctcctgatagagttccaacaagatctgtttgtttaaaagcatatagtccctcccatctctcttcctcctgctcctgccatgtgagacatctcactccccctttgccttcgctataattgtaagtttcctgaggcctccctcggagcctcacagatgccagaatcatgtttcctgtacagcctacaggactgtgaaacagttaaacctctttttattataaattacccaactcaggtatttctttgtagcaatgcaagaatgaactaatatacctgggaagctatccctttcataccagagcattttcccaaatagtcagcactatttaacagcatgcaggtgctcaaatctaggtattattgagaaatacctagccaaaagagtatcttccccaagatcgattatgtgttactcaggtatagagaatttgtttcaccatgatttattgaagccatgtctgcaaagctatattaatactttacccgtattgcaggagaagacagaggggggcaaaaatatttagagtgaagggataaataaatgaatgaatcaaatatggatcatcagccaagacgtggaaataacctcattacttgaaattgaatgttttaatgttattcattaaagtagattttgtctgtatttgtgacatatgtgtgcttaaaattcatggagaaaatgagcattttaattacaaaatgctgaaatcattaataatttaaagatcatcattcagcctccctttctaagtaatctagtctatgctaaaccctcacagacacatcagacaagtcaaggacacagtcaaagggcaggtccaaggggaagggcgaaggggtggggccaatttctcctttactcatgcacacagaagaatttaagcccaacctaccagaatgtatgtggcttaggatgttgcaggggaagtaaaagaaccagagatcacatagatggtgtgaccatctgggtgatctcaccctctctgttaaaggctacagccaccatccgccccttctctcacccaggagcccacaccaggcaaggcagcctcccctggttgcaaagcagcctgcttcctttttcgccttgcttccttcatccgcttgtgtgcacccccaggaaggcgtctctcctcaagtcccatccactaaagcaaacccacccattaagacctcgtcaaatgccacatcctccaagaagcaagaggggcccccagcacccagcccagtcttcatttcacctcctctgtgcactcccgttctcagcactgtctctgtgactgtgcttaccatgtgctcttgtctctaaagaataatgaaggcccaatattcaggatgcatttaccatgtggtctcatggccagctcacacctcctccactcagccaccctcaaggcagggagagtatcctcactttacagagcgagccgaggccaaagggtaagtgacttgcccaccgtcccacaagcaatgttggaaatacagatgaacgctgatgcacccactccgtccagggggccaccaatcacatgttcacctgagtacaggatactctggaaggctgagcaaggccacactaaggaggatatggttcccccactaccatcctcccctgcgttggggttcactttcagggtctgatggtgaattgtgagttacatctgccccatctgggagatgtacaggttatacgcctgatatggtttggctgtgtcaccacccaaatctcatcttgaattatagcttccataattcccatgtgttatgggagggaactggtgggagataattgaatcatggggattgtttccttcatactgtcctcatggtagtgaataagtctcatgagatctgatggttttttgtttgtttctttttgagatggagtctcgctcttgttgcccaagctggagtgcaatagcatgatctcggctcgctgcaacctctgcctcctgggttcaagcgaggcctcctgggttcagctactcagcctcccaagtagctggattacaggtgcacaccaccacacctggctaattttttgtatttttagtagaaacggggtttcaccatgttagccaggctggtctcgaactcctgacctcaggagttctgcctgcctcagcctcccaaagtgctgggattagaggcgtgagccaccgagcctggccaagatctgatggttttataaggggtttccccttggcttggttcttattctctcttgcctgctgccatttaagacgtgcctttgccttctgtcatgattgtgaggcctccccagccatgtgaaactgtgagttcattaaacctctttttctttataaattactccttctcaggtatgtctttatcagcagggtaagaacagactaatgcaatgcctttaaataacacagtgtgtaatgaaatagggaaccacagataccttctgttactgcacaaagatttgccagtaagggcaaggtacttgtaacagttgtcaaacataaagagtttagttacactttatttgcacccaaaacacaagttttctaaattggcttgattttttattttgaagacaagaagtaagtattcagctatcatacaaatatttttgaaaaataaacacattccatctgtcccttcaaagtgaaagtaacattttaattagtgcatgaaagagagtaatgctatgcagagtttctgaaaacagatacctgggaatgttttcattattacatgactttgctgcccaaaacaagataatatgtaactctcatatccgcacacttaaaactgaattttctaatccatttaaaagacttccaaatgcatttttgagtggattttgattccctatgtttaaaattgcataactggtggatgggatttttaaaatgaatttcatggtttagtaagcacactcatgtggatctacatatatctctgaggtgtcactcccagctaagacagctttaaaccatgttaaaatgagctcatcttagaaccaagcttcagatcactatatcactatatataaaacaagattttttaataaagcatatttgatcatattgctattattaacatttttaatgtattttagtaagaaaaaaatggtaccaaaaatttcaataccataatggtattaaaattccataaatggaatttatgtaatgtaattccataaatggaaatacaggcctggcatggtgcctcacgcctgcaatcctagcactttgggaggcggaggcaggcagatcacctgaggtcaggagttcgagactagcctggccaacatggtgaaaccctgtctctactgaaaaaaatacaaaaattagccagatgtggtggtgggcacctgtaatcgcagctactcgggaggctgagacaggagaatggcttgaacccaggagacagaggttgcagtaagctgagatcgcgcaactgtactccagcctgggagacagagcaagactctgtctcaaaaataaataaataaataataaatggaaatacattactttgtaaatattgtatatcttatctttagttcatttgtagtttctatttttatatactttatgtatgtgtatttttgatgccttttagccaaagaccaccaggaaaactcacagcgaggggtctcagccacaactacataggagttgtggagtgaattctagtcagaatgatcacagtgagaagaagcacaatcctggccttgtggctaccattttaacaccaaaaaagcaccattctaatgccggaaaacccaccacttctgcaatctctgcctaactcctgcaaactagatagtgaagccccctctcccaggaagccctcctggactgattgtctactctgggcagagtctcctcatcatcccctctgctctgcttctcccactgtgttttaatgatctgtaaactcaaatggcttcttgctaaggccaaaggccttagacgctaagggctgtgttttatccaccaccacattgccaacccctatctcactgaatagtccatagtgttctgtgaagattgtatgttctgtgaaggcctggagaagtatatccctggaatatccctggagtggcacagccctggagcccactcctcccctgcactcaaggaagggcagtgcagctccccccactccgctgtgcagaaacgcaggcctggttgaattggattctgcaatctaatgagctccactggcaaccagcacgcaggcctggcaccaactctcggcacctgattttctgtcacataaagtatattttaagtatacagcctttgtttgtgtccagcttcttagtgataggcccactgggaactgctgcttcctggctttctgcagcatgagggaggccaaggccctgccagaattttccctccgggggcttgcttgcctctctccaccaactttcctgtcttcctgtcctgcgacaagggtcaccttccccacccctaaatccacacccaatggctacatttggtttgagtgtttttaaataaaactttcaaatctctataggacgaactgacaattttctttggaaccaaatccattatatatcataagcccggccctcgtacttcataaacaatgggcatttttcacctttaccaaataatgatcaaaccttccctcacttttgtatgtcatgatcagtgataggatctttcagcatcagagatgaggctgacagttggtattactttatttcagccttacttggagctcatcccttgggcagattgcaataaacctcctggcactgcaatacagcacagcaccattgttcagtcgacaacaattccatggagagcatccaaagtaccaagcctggtgccagcagctgggctggagaagagagtggggcacacagttccccaaggccagcaacccggcagtgagcaagctgcagctgtgactgcacagcctggtgatgctggctgcaaagacttgacacagatgcgtggaaaatcaaagaagtcacttgtgatacgaacctcgtgatgctggctgcaaagactcgacacagatgcgtggaaaatcaaagaagtcacctgtgatacgaacaaaccgcactgtgttgagctgaactgtgttcccccaaaaaagatatattcaagtcctaatacccagtacctctgaatgtgaccttatttggaaatagggtctttgcaaatgatcgagttaagatgaggtcatgagtgtgggttttaatcccatgtgactgtgtctttatcaaaaggggaaatttgggccaggcaccgtggctcacacctgtcatcccagaactttgggaggccgaggcgggcagatcaccggaggtcaggagttcaagaccagcctggccaacatggtgaaaccccatctctacagaaatacaaaaattagccaggcctggtggcaggtgcctgtaatcccagctactcgggaggctgaggcaggagaattgcttgaaccaggaaggtggaggttgctgtgagccaagatcacaccattgcactctagtctgggcaacagagcgagactccgtctcaaaaagaaaattggggaagggggaaatgtggacatagggggaagacgagtgaagaaggccctgtgatgaccgaggcagagactggaatggtgcagctgcaggccaaggaacacagaggattgctggcccccaccagcagctgggagagagacgaggagggattctccccaaaagcctcagaggagcgaggcccggccagcacctggacttcagacttctaaactccagaactgcagacaacacacttctgttgttttaagccacccagtttgtggtactttgttgacagccgtagcgaactaatacatctaccacaaagtagagggtggcagccatccagttatccagtgagtaattgctaggcaccctctagacattgaggagacttttctaatcatgaaggggtgcacaggagaaggataacggacaaagaaatgcctaagacaatgtcaaggacgaatgccactcagagaattgccacagcgagggcccagtggctcctgtggactggacggtcaggaacagtgcctctgaggagggacacttaggctgagagatgaaagaagagaaggggccgttcctggcagagggaatggataaaacaaaaaccttaaggttgcagctgggcgtggaggctcacacctgtcatcccagcactttggaaggctgaggcaggaggccctcttgaggcgctggacgtggaggttcacacctgtcatcccagcactttggaaggctgaggcaggaggccctcttgaggcgctggacgtggaggttcacacctgtcatcccagcactttggaaggctgaggcaagagaatctcttgaggccaaaaattcgagaacagcctgggcacatagcaagaccctgtctcaaccaaaatttaaaatcaaaacccaaaaaagccttgcagtgggaaacaggtggcatacttgaggaacgggaagcaaggttctccatctggaacagaggggaggagatgcaatcagagatgggtaggactcaaacgatgtgctccagggcgttcagatcctacaatccccacaggcagggcatttccagacaccacctgtgtgagtttcctggggctgccgtgagaaatgactccagactgggtgccttaaaacaatggaaatctattatctcacagatgaggaggccagacgtctaaaacccaggtgtctgcagcgggagctctgagagagggcctgttgcatgcctgtcttctgctccgtggccgcagccgtccctggcactccttggcttacagacgctcattcccactccaactccacgtggccttctcctccccatgtctctcttggtctgtgtccaaatttccctcctgtaaggacctccatcattggattaaggcccatcctaatccagcatggcctcatctcaacatggctgcatctgcacagggccccctgtgtttccacattcagagagcaggggttaggattccaacacacctttcccaggatacggttcaacgcacaacactacccaaggcctgctttctcctcagggccccactggtactagcagtggatggggaaggctgagtgccctcccatatggccaagggaggcccagatgcagcccacacacggcactgccatggcccagacagcccatggaggggggagccccacctactacagctggccactgatggccaggcctccatggtgccagggaagaagatgacaaggactgacaattcttcccccaccagcgcagacacagacagccagggttgctcagcactgcacgccatgcagccccagacaaagggaagaagaccgcaaaccaactgaattcacacatcaggcacctagcagagcagggcccaggcagacaacagagctgcaggccaatcgcgatggcccctggcctgcacccctgtgtatggtggggttctgccctcctagggaatctgccgcagccacagccctgctgggagtcaggtgtatccggcacaagggtgggccctgtgtgagactcatctcctgggaccagagtgacacaggcttagtggcactacctggtgtgccctcccccaccccaactggtcctgttcccagatcccccaggcatgatgaaggggattcagtggggaggggaaggacagggctctgttattcagacccacaagacactggggcaggcacaccacagcacaaagggagtgcagggagaggggctttctcccagctcccggcctcagggagcacaaaaccctgggcaccccgagggctccagcatttccgtggagcagtagaggttcccgaggcaccatgcccgggaatggcagtgcctgagaggtggtggcgctggggaagcgaggctcacttggggaccctccacgcagtgcaggaggccgccagctccaggagctgctgcagaagaaggagatagactatggggaagagggtgggactgcttcatgagaaccaaggaaaagcccccagactcccagcaacagaaggaccttcaaagtcccccggcatagcaggagataggtgtcatcagtgtgcaggcagctccgttaggacttcacggcacagcctggggagcccagaataagctcccattcccactgcttagctgcacaattgagctcatccgtttcaggtccagcatggagccagtttccaaaatgccacctacatattctatggttcaatcaacatcatggcaaactaaacagtaggcagccacctggctgtcattctgccctgaagggtaagatgacgaggtctgttgttatgaactgaagtttgtgtccccccagaattcacatgctgaagctctaacacccagtgtggctgtatttggagagggggcctctaaggaagtaattaaatgaggtcatcagggtggggttctgatctgataggattagttcttatgagaagagacaccacagagcccactcactctctctgcctgcacccaggatatgtgaggaggcacacgggttgtccacaagccaggaagagagccctcgccaggattcgaagcggctagaaccttgatctcggacttcagcctccagaactgcgagaaaataaatgtctatgtcttaaaccacccagtctgtggtattttgttacagcaacctgagaggactaatacatctgtccatccaatacctccccaaggccagtccctggaggggctccagagtggcagctttagcactgttgagaagaagaaatgatatcctcggccaaccgcacccagaatctcaggcagttatggggagggaggctcaaatgcagattccccttgaggccaagagatcctgattctggggtctggacgggagctgggtctgtccgttgttagccaggcctcactgtctgccaccgtgactctgatgcagaggactcctcagcacacttcagccaatggctggagtgagaaaagggagccccagcggcggttggtgaggtgtgagtgttaggttcctaacaggatgagggatagaaagagctgaacttccagagaaagaatcagaccatgagaagacaaacctcaagagcactctcacttcctgtgtttctccttcatgaaattaatcttacacaaagaaatgataaatatttgaggtgatagatactatgatttgatctttacacattgtattcatgtctcaaaatatcacatctaccccataaatatgtgcaaatattatgcatcaatttttgaaatgaaaaaaataatttttaatgacaaagtaatatatgatataatatatgacattagtttggttgaagcattgacattctgataacattaatatcttttcctttttccaaaggaaatggctattagaaattggggccaggcaaccaacccaaatgtccatcaatgatagactggattaagaaaatgtggcacatatacaccatggaatactatgcagtcataaaaaaggatgagttcatgtcctttgtagggacatggatgaagctggaaaccatcattctgagcaagctatcacaaggacagaaaaccaaacaccgcatgttctcactcataggtgggaactgaacaatgaggacacttgcacacaggatggggaacatcatacaccagggcctgttgtggggtggggggagggggtagggataacattaggagatatacctaatgtaagtgacgagttaatgcgtgcggcacaccaacatggcacatgtatacatatgtaacaaacctgcacattgtgcccatgtaccctagaacttaaaaaaaagaaaaaaaatagaaattggggccaggcatggtggctcatgcctataatcccagcactttgggaggcagaggcaggtggattgctagaacccaggagtttgagaccagcctgggcaatatgacaaaaagccgtctctacaaaaaatacaaacattagccaggtgtgatagtgcacacctgcagactgaggtgggaggatcacctgagcctgggaggtcgagactgcagtgggctgtgattaagccactgcactccagcctgggtgacagagcaagaccctgtctcaaaaaaaaaaaagaaaaagaaagaaatcggtgcataacctttcagacctgttacatacctttacatacatacaaattcccatatgaaatatacaaaattattcagtgtgtgtttttgatacaaattatatcctactttacgtattatcctctaatttgcttttttcatgcaacagtacttcctgaaactctatcaatgtcagcatattaaattccatttatacctttaactgctgtataatagttcaatgtataaataaaatgcattatatatttgactattggtgggcagttatcagttccagttcttctctattacaaagattcaatgaccattgttctacatgtttcattgttcacattataagtgctttctttttctcttttcttttctttttttttttttttcttttgagacggagtctcgctctgtcacccaggctggagtgcagtggtgtgatctcggctcactgcaacctctggctcccgggttcatgtgattctcctgtctcagcctcccaagtagctgggactacgggcgcccgccaccatgcccagctaatttttttatatttttagtagagacagcgtttcactatattggccaggctggtctcgaactcctgacctcgtgatccacccgcctcagcctcccaaagtgctgggatgacaggcatgagccatcaggcctagcccccagactgcacatttaagcggctgaacgggggatacttcccaacactttgtcctctcactctagctgacattagaaagcttttcatcatttgatgatctgatgagtaaaagagacttcactgtagttttaatttgcttttaccagattaaaaatgagattgagcattttcccatatgtttaatagccatttgtattcacgctcctataaatttcttttcatatcttttgaccattcttctattggatagttttctttttcttactaatttatggaagttcattgaatattcagcatattatggctttatctgttgcatatatttttcctcgggctgtcaattgccttttaactctgtttacagtacattctttatgataccatagttttaatttttatctaaccaagttattcatgctttcctttacaatttgtgctttaaggcctctacttggggaaaatggatcatggctcctgcaggtgtgtctgtatcctagtctggatcctataaatattaccttatctagaaaaagggtctttgcagatgggattaagtgagtgatcttgagataaggagatgaccctggattatccaggtggccctaaataccatcaccagtgtccttataagggaggcagagggaagtcagactcacacagaggaaaaggtcatgtgaagacagaggcagagactggagtgctgtgacctcaagccgagagactcctgaagccctgggcattccagaagctgaaagaggccagcaacaacgcttcctagagcctccagagcgggcatggccttgaggacatcaagattacagacttcctgccttcagactgagataataaatggatgttgctggttttaagccaccaagaagctccagtttattgtacaatttgttgcagtggtgatataggacactaaagtactactcaaggtttgggggggtggggaaagcctatattttcttcaagtggttttaaagttttacttctgcattcaagtctttaatccctatgaaatttatttctttgggaaattaaattcaagcctttttttttcctgcagataaccaatggttcccatagtacttattgaatatctgtgttagtctaggtcctctgagaagcaggagccaggatgagatgaaatgagcaggggtggctgggcgcggtagctcacacctgtaatcccagcaatttgggaggccgaggcgggcggatcacctaaggtcgggagtttgagaccagctgaccctcatggcgaaaccccgtctctactaaaaaatacaaaaaaactagccaggcttggtggcacacacctgtaatcccagctacttgggaggctgagacaggagaatcacttgaacccaggaggcagaggttgggatgaggaagatcacgccattgcactccagcccgggtaacaagagcgaaactccatcttaaaaaaaaggaaaaaaaataaaagggaaaaaagaaatgagcagggggactactgggtattactggatatctacccagaggaaaagaagtcattattcgaaaaagatgcttgcccacggatgtttatagcagcacaatttacaattgcaaaatcgtagaaccaacccaaatgcccaccaatcaacaaatggataaagaaactgtgatatatatagatatcatatatatcatatatgatggaatactacacagccataaaaaggaatgaattaacagcatttgtggtgacctggatgagattggagactattattctaagtgaagtaactcacgaatggaaaaccaaacattgtatgttctcactgatatgtgggagctaagctgtgaggacacaaaagcataagaatgatacagtggactttggggacttggggggaagagtgggatggggccaagggataaaaggcaacaatagggtgcagtgtatactgcttaggagatgggtgcaccaaaatctcacaaatcaccactaaagaacttaactcatgtaaccaaataccacctgttctccaataacttatggaaaaataagatttaaaaataagaattaaaaaaaaatgagcaggggtttattaggggaatcacctttgagagatcgggggtaagaacggaggaggctggtggaggacagctggaaagaggatgggaaggaggcattctagatgcccacagtctaagggggagcccctagtcaaaggcacccatcagaagaggcctgcgtctcccaggaagagccggtcctagctcccctgctcgcaggcaggagctggtgcaatggacttcccagagcggggccttgctcattaccctgtgtagctgaagctctgcaaggtgcattcccgtggccaccagcccactttttcccactgacttgagagccacctctgtcaccaaatctgctcatgcacagtcaatcacttcctcaccctcgccagtgtcccactgctttcgccactgcatcttaagagtccgtccaggtcctcgggaagaaaagcatcctgcccttctccttctcctgggacccagtagctttggcttttattctgtgtttactcgttcgtatgaaatctagaatggatttatcaacttcctggaaaaatcttgtagagattttgattggcaactcattgaatttataagctcgtttgagaaaatgtgacctccttaccacatggaaccttcccattttttaacataattcatctctccttttatttaggcttttttttatgtcctactatgacattttgcagatttctccatctaggtttcacatttttttaaaaagacttttttttttaagagcagttttaggttcaaatcaaaattgggaggaaggtacgcagacttcccttatcccctctgtccccacacacacgcacagcccctcagacacagctggcatccacaccagagcatatgtttcttacactccatccacccacactgatatgtcagtatcacccaaaatccatggtttaaattagggttcctccttggtgctcttcattctatgtgtttgaacacacgtataatgacatgtatccaccattacaataacacacagagaattttcactgccctaaaaattttctgtcttccacctatccatccatccccccaaccctaggcaaccactggtctttctactgtccccatagttttgccttttccagaatgtcatatatttgggagcagatgtatgtagcattttcaggttagtttatttcactcagcagcatgcatttaagttcttccatgtctttttatgacttgatagctcattttttaacactgaatagtattccactgtctggatgtaccacagtttgtttatccattcacctactgcaggacctcttggttgcttccaggttagggtaattatgaataaagctgctataaacatccatatgcaggttttgtgtggacagaagttttcaactcatttgagtaaataccaaggaaagtgactgctggatcctatggtaagagtatgttttcttttataggaaactgccaaactgtcctccaaagtggccacaccattctgcatttccaccagcaatgaatgagagctcctgctgctctacgttctcaccaggattcagtgttgtcggcatcctggatctgggccattctaatagctatgtagtgacatctcatggtcatttggttttaacacttttttgttagattttgcatctgggctgtgttcacttgtgagttagaggaaatctaaacaccaatggctgtaaccagtaaggtcccctacctctttgtctctccctcccaacctcacccttcaccaagaagcccaaggtaaggcagcccaggccagtgatttgctccaggagatcatcaaggaactgagcatcttctgtcttttcctccaccatcttcagcagaaagtggtcacaatgtgatcccaagaagcctgctgtacctcctggtatcttgtctgtattccaggcaggaagaaggtggaagagccaacagcagcttcttaccaagtgctgtcttcttatctgatgaggagccccctcctgcaggaattctacttacatatcattgagcagaccatcacacggctaacaccacctgcaaagatgctgagagatcctttatctttggtgaatatattgacaagccaagcaaagcttaaggggattttttagtaaaaaaaaaaaaaaaaaagttaaggccgggtgcagtggctcaagcctgtaatcccagcactttgggaggccgaggtgggcagatcacgaggtcaggagatcgagaccaccctggctgacacagtgaaactccatctctactaaaaatacaaaaaaaaaaaattagccgggcgtggtggcaggcgcctgtagtcccagctactcaggaagctgaggcaggagaacggcgtgaacccaggaggcagagcttgcagtgagccgagatcacgccactgcactccagcctgggcgacagagcaagattccatctcaaaaaaaaaaaaaaaaaaaaaaaagttaaaaaaaaaagaggatggctaggcctttggcatggttgccaaaggtgtagtctccaatacccaaaagattttgttagtattatgtattgtgttagtattatgtattgttagtattatgcatttgttagtattaataggatcatttttcctattgaaatttctaattggtttttgctgaaggaagaaaagttgccaatctttatatgtccaactcacattcagcactcccgctaaactaattaattggttttaatcatttgtcaggttattcttcggattttccaaactgagcaattatggcctcggaaaataacaagagttttgtttcttcctttccaatttgtatttcttttcttgaatttgggctaagctgtgatatgggagatgtgatttgactttaattttgtggcaccgctaggcatggtggttcctacagtttcctggtttacatcctttaatagttcagggagttctcctttattcagttttctaggtgtttgtgtcatgaatgaatgtttatgggagctggacaaatggcaggatctactgtgaaaattatggggatttttttccccactaatttagtaaagcattgacaaattgacaatttgtccattttttgttgttgttgaaccaaccctagtggctcgagttatattatattattaataaattataggattcaatttactaatattttctttgtggtttttacatgtacaagtataatgatcctttgtgtgtgtttttttttcttatgctttccttatcttattttgataatagtgtttttactaacttcacaaaaggagttggtcagctttccatctttttctaaactctagaatagtttcaggggatttaggttatttgttccttaaatactttataaaaatcatcttttaaactctacggatttgttgcctctttggttattgatctttgtctatcatttccatttatctaatgattgtgtctctatccaggttttctacttgctcttggatcaatttgtttatatatattatcttagaaagttttcaacatcagtcattcttagtgtattggtataaaaatattcaattcttttataatttttgaaggttgatagtatccgtagttataaatccttttttgtttactcatgatatttatgtcttctctcctttttattgattatacctgtcaaaaatttgtctattgtgttaattgtgtcaaagaacttgcttttggttatgttgatgactggaatttctggccttctgtttcattaattcctgcttgtatattagttttcttcttcattctactttctttagatttttgttattcttttttatagtttcttaagttgaaagcttagctcatttatttttaatctttcttgttttctaataaatgcacttctggatctaaattcccctctgagtaccactgtggctttatcccataactttttatgtgcagaacttttacagtcattcggttttaagtactgtactccattatgatttcctctttaaaacgtgaattatttagaaggtttttttttaacctccagatgttatgcggggatatcctgtctatctttatgttgtcggttactatttttactccccggtccccattggaaaaaggacttgatgacttcagcctttgaaaattgtggatttttctttgttgcttagtacatagttaattttttataaatttccccatgtacttaaaactaatgagtatactcacttggatgtagagttaattaaattcttcaaatcctttattttcttattaattattattctacttgctatggtagcttttgagaactcatttcttgtggccgcggtaacaaattatcacagactcggtggtttaaaacagcagaaatttgttctgtccaagttctggaggccagaaatccaaaatcaaggtgtcatcagggtggtggtccttctaggggctctaagggagtctgtccctggccaccttagcttctggtggctgcccaccttcctggacactccgtgacttgtgccaacttattacaatgtctaccttccccttcccatggcctccccctctgtgtcaattctctgcctctctcttaaaaagatacttgcaatgacatttaggaaccacctggataatctaggatgatctcatctcagtgttcttaaattaattacatctgcaaagaccctttttacaaataaggtaatatttacagattccaaggattaggatggggacatgtctttggagccaccattcagcccgctacaggaaagatgtgtcaaaatctctccaggattgtcaatttctccttgtaattcaaaggaatggctgtatttcaaaggtattgtattaggtgcatacaacgtcaaaactattatatctccttcgtgcattttcacttgtattaatatgaaatggctgtctctgtccttaatacttttcatcttgagatctaatttatctgttggaatattgctacgttcttctcttttattaattttaaaactttctgagtcattatgtttcatcctgatttttatttcattgtttacgttgtcacaactgataagtttgggcttatttagccattataacatattttctctcttccccctgatttctctaggtttcctttcctcatatcttccctaaatctgaccagcggaagccacggcctggggtgttttctggttcagtcacaatttccagggtaggactgtattgtaagaagaatgcggtcactctccccaagcgcacattatcacacttcttttaagcaggagatcttaggactgtgtgagtggccagtcacatttccattttgccagaactaccattattcccacagcctctggaacaaaacctcttgctcgagaaggtgcttcagatgaactcactatttgaaaatgcatcttgttacgctgtttttttgttttttgttttgttataaataattaagttttgagggattctgcagatgcgccaaaaaacacgtgtccggggtaaaagctgtggaaggtgctcggttctaaggagagggaaggaaagccaagtggaccctgtcatctgaaattgttttgtcatccactgacttttacaaataaaacagccgggcgcagtggctcacgcctgtaatctcagcactttgggaggccaaggcgggcggatcacgaggtcaggagatcgagaccatcctggctaacacggtgaaaccccatctctacttaaaaaaatacaaaaaattagccgggcgtggtggcgggcgcctgtagtaccagctactcgggaggctgaggcaggagaatggcgtgaacctgggaggcgcagcttgcagtgaaccgagattgcgccactgcactccagcctgggcgacagagcgagactccatctcaaaaaaataaataaataaaaataaaaaaataaaacaagctgtggcagagtaggttctgaaagggtcagaggggacagtgtgctctgagaaagtgggcccacgaaggtaaacagcgctgccagcctgcggtgttgctttgccacccagggcaagcattcttggcacatttcagctgcagctgctgagctagtaaaatctgagaaaagaaggaacacagtgaataaagaagacagaagtgaaagaagagagcgcagccaagagaggctccagataaggccgcgatgctagggagaaaaggaatttataacacagagaatacacggcgctggggctttctcgcatttctgctatcgccgttaaaattatccgggttcaaatagagaaatgctctgtcctagtcattattcatgtttctttccaaggcacaaattccagcataggcaattttggcaggaactgaactatttatttactggattcttgcttacgaccaggcaagcagaaagccctccagcacgcacagaactggggctggcttcctctctccgatggctcctaggaggatctgcctgacccaaatgagtgccagctataaaatctcagcaaggccaagggcagaggcagcgccactcagcgagggaagccataaactagacagaaagacctccttgctccacactctcctggatcacatcctcaggtggagtttaaatcactgtgtcccagtttccacgtctgtgggcaggtgatccggcacccgcaaattcagagctgctggcatgaaaaccctataaggtgattagacacactggcttcaggagtgtttgatacagacaccacgttcgccgcccacgaatcgcccaacctcatattctgttttgctctgaatgtgccacagcgatccatcttccaggtccgatgggacctctctccagccccccgcccctgacctgaaccctcctcctggttttacttgaaatcacaaactcaagactgcccccactccccccaggtcctaggctgtgccctttatgattcagcccgagtccctgggctgctagtgaggagggcaccttgcttcccggccctcagagacgcctctctcccaggcttcaggcttcatggcacctggttatgaccttttctcaaaaggacctgcagatcttggcctaaaacggggaggagccccttggggagatgtagagggaacttgggtggagagcagagggaggaaggaagggtccctggggaaccagatcagctgattctgtgcgggaaatccgcagggagcgagcagtcactcagctgtcctaaaagccagcacagctcatcttccctctagaatttataactcttcaaaattctagccttgggccagaagtggtgggctcccacctgtaatcccaacactttgggaggccaaggtgggaggatggcttaaggtcaggagttggagactagcctgggcaacatagtgagacccccatctctacaataaatagatagatgatagatagatagatagatagatagatagatagatagatagatagatagacagatacagtctagccttgtttaggcccttctctctcagaacatttgctttgttgaagtgtgagcattccccagtaaattatgaaagttggttggctaagctggttcctctagacagctgctatggatggaatgcttgtgtcccctcaaaactcacgtgttgaactccttgcccccaaggtgatggtatttgggggtaggctgtggggaggtgattaggtcatgcaggtggactcctcatgattgagattagtgcccttatagaagggatcccggaaagctctctcagtctccttccaccatgtgaggacacagtcagaaggcagcgatctgcagccaggaagagggccccagccctgctggcaccctgatctcgaacttccagcctgcagagctgtgagataggtgtttattgtttaggccactcagtcagagacagaagctcaagcagacaaaggcagtgaccatgccacacagcctcccctgacccctggccctacgggaaggtcactctatgcatgcctgcactctctgtccagtgagccctgagtccctgtcttctctctgaggggcacttccagccccaagcccatgcaggacaaagatgatgggtatgtggtgcccccagggcctggcagcctcccctgtgcacagcagcaggtctgccctgtgtgccctggccctggggcccagtgttcagggcatctcagaggtcctgccttccgcaggactccttgccctacacaccaccagagggcacatgacctgaaaggaaaagatccatgtgtccagttgttcctcagtaaacatgtattgagcacctgctgtgagccaggcacaggcccagcccccaggatgatcaggcatgcagtgtccctgagctggggagccactgtctgtgaaggagactagaacaaacagctgaagcacagggcagcacggattccacagagcctcccacagcctcctcccatgtgtgcagggaaggcctggaagggggccaacagcagccaggcaaggagacccaagcctcccaaatacaccaccaggccccacccttcaggttcaaggagccctgggctggtcaacagccaaacatctgccctgctttgcatggtggattcaggtcaacaacacaccccgttggtgtgcacgaccagcctcagccaggcttcttgtacagcgcctcgatgtccagtccaaaccaggccacctcaagcccccaggccagaagcattgcagagaacatccttctcacctcctgggctgtccaaggggctgggtcctgccaggctccctggtttttcatggctccctgtgggtaagcaacaccttcttgcaaggacagagagggtcctgtacacgccaaagcttctcaaactccctgtgggcaaagaccaggttttgctttctaatctaccacagactgtcacttgtataaaatttaaaataatttttagaatagtgaaaggcaaaaagacatacaaaacatacgcctcaacagagtaaagagacaacttattgaatgggagaaaatatttgcaaactatttatccaacaagaggctgatttccagaatacacaagcaattcaaacaattcaatggcaaaacaaaacccaataatcccattaacaggtgggcaaaggatctgaataaatgtttctcagaagaaagataaaaacggcaaccggtatatgaaaagatgccaaatatcgctaatcatcaggaaaatacaaatcaaaaccacaatgagatatcatcttaccccagttagaatggctgttatcaaaaagacaaaatatttaaaatgctgataaagatgcagagaaaagggactctgaaacacggttggtgggagtgtaaattagtaccatcgtggaaaacagtgtggaggtttctcaagaaactaaaatatccaatgacggacgcagtgaagctccctgacctgccacagtgcaatatattaatgtagcaaaactgcacttgtaccccatgaaaatatacactttttaaaacgaaaatatttttaagaactgaaaatagaactactataccattcagtaattccactactggggatttatccaaaggaaaggcaatcagtatatctaaaggataggatacctgaccccaatgtttattgcagcactattcacaatagtcaagatgtgcaatcaacctgcatgtccaccagcaaatgaatggataaagaaaatgtgatgtatacacaatgaaatactattcagccattaaaaagaataaaatcctgtcatttgtagcaacatggatggaactggggatcattatgttaagtgaaataagtcaggcacagaaagacaaatatcacatgttctcatttatatgtgtgatgtggtttagctgtgtgtccccaaccaaatatcatcttgaattgcaataccccaggtgttaagggaggaacctgatgggaagtgattgaattaggggacagttttccccatgccattcttgtgatactgagtgaattctcatgagctctgatggttttacaaatggtagtttctcctgcactctcacacacgtttctctctcctgccaccatgtgaagaaggtccttgcttccccttcaccttccaccatgattgtaagtttcctgaggccccccaagccatgtggaactgtgagtcaatgaaacctctttcttttataaattacccagtctcaggaagttcttcatagtagtgtgcgaatggactaatacaatgtggaagctaaaaaaagtggatcttagggaggcagagagtagaatgatatttaccagagggtggggaaacacggggaggaagataggttggttaatggatacaaacatactgtgatggttaatactgagtgtcaacttgattggattgaaggatacaaagtattgatcctgggtgtgtctctgagggtgttgccaaaagagattaacatttgagtcagtggtctgaggaagggagatccacccttagtctgctgggcaccatctaatcgcagccatcgaatataaagcaggcagaaaaacgggaaaaggagagactagcttagcctcccagcctacatttttctcctgtgctggatgcttcctgtcctcaaacatcgaactccaagttcttcagttttgagactcggactggctctcctatctccttaagcttgcagacagcctattgtgggaacttgtgatggtgtaagttaatacttaataaactcatatatatatatatatcatatatatgatatatatatgagtttatacatatatcatatatatgatatatatatgagtttatatatatatcatatatatgatatatatgagtttatatatatatcatatatatgatatatatatgagtctatatatatatatatcctgttagatctgtcgctctagagaaccgtaatacatatacagttctcgtgttcaatagcacagttgattgactacagttaacaataatctattgtatatttcaaaatagctagaagatttgaaatgttcccaacacaaagaaatgatacatgttcaaggtgatgaatatcctaaataccccaatttgatcattacacattgtgtgcatatatcaaaatatcacatgtacaccataattatgtacaaatatcataaaatgtacatatgcaggtaaatattttgcccttagcttcaacggatataaaattactctatcaagttgctacaaaagtttctaaacactctccatttcagcacttatctcaccacagaaagtaacaaagagttcttggactggcatagcccgtgaactacctggaattgtgctgccccggactgagggtcagcaaactcctgcccaagggcaggccaaatccatcatcttgtcatttaagtattgtctgaggctgcctttgggctttcgtgctacaaaagcagacttgaaacaaccacttactaaatggccttttattgaaaaatgtttgccaactcctgccctagtctacttcaaaaacactgcccacccatctcagtacctccagtcttcccaaagccacagctgcttacctcctccagtaaccatgagagaatttcttcaataacgacaagaagatagtatttaccaagtagatcagcttcctagggctgctgtaacaaattacagcaaagggtggcttaaaaacagaaatttcgtttcccacagttctcaaggccagaagtccaaaatcaaggtgtagagatggctgtacttcctccaaaagctctaagggaaacaccttccttccctcttccagtttctggtagctcctggtatttcttggcttctccctgcatcaccccaatctctgcctccatctccacatggccctcttgtctatgtctgtgtcttctcttctaagtccgcctgccattggacttagggcctatctggataatccaggatgatctcatctcaagatctttaaattgattacatctatgaagaccctttctccaaattaggtcacattcgcaggttccaaaagttgcaacattgatactatggtttgaatgtttgccccctccaaaactcgtgttgaaacttaatccccaatgtaatattgttaaaatgagaggcctttaagaagtaacaccaacatggtacatgtacacatatgtaacaaacctgcacgttgtgcacatgtaccttaaaacttaaagtataataataataaaatttaaaaaaaagaagtaattggatcatgagggctctgctccaagtcattaacgggttaatgaattaatgggttatcactggagtgaacctgttaaaaagccagtttggctctcagtgagcctctcttgccctgtgatgccttcaccatgttatgacacagcccaaggccctctccagaagccaaccagatgcagccacctgatttggacttcccagcctccgtaactataagaaataaatttattttctttataaactacccagtctccattattcagttacagcaacagaaaatggactaagacggtggacatatcttctgggtgggggcacggttcaagccacgacactgagtgtttactctgtaccagacggtgttctcattctctaatctcaacctcacagcacctttatgtggaaaacactgtcctcattttacaaatgagtaaatcaagtccccaagaagaatccacatataattttccaaggattacacaatgagacagaggtaggattcaggcccatacccataaccactgcaacctgcagccctgagggtcttgggagcattcactgggtgctctgcgtgtgtcaagcagcagtctcagcactctgcacatatcatggccccttaattctcataataaatatgggagattgccgttattattattattattactttatagaggagaaaatagagatttagtcttaaagactaagatcacccagctaatcagtggcaacattagggcttgaacctaggtctattggaaaacaaagccagactcatttctacgacactaagcaaaactttgtataacagcagggcaattcccaaactcaaactccatcagcctcagagagtaagcccatgaagttatcatgagccactgagattgtcacctcctatccttgctgagtgagtcctgacgggcctcagggccccaggctcccttggtcctgtggctcagacttcaccaggccttcaggtcttgcgaatccagccagaagatggggaagaggggaggagagtgacacactcacttcttaacttgccttggaggtgacaatgcactctttttcacattccattggccagaactagacacatgcaagggaggctggggcactctacatcatggaaggaggcccccaaattttaagcagacaactagtcacctccctatattaaaaagctattttataaaaccttcgaaattctcagggttttggcacatagcagtaattcagtaattttttgaatgaatgattgaagctaactggggaaaaataaagctggctccacaagctggacagcagagctaccggagcagtaagtccgcagtggtcaggtgtagtgcaaagtactactggcctctatgaccctttcctacaaatgactaaaaggcacctcttctttaagacttccgtctatcataaaatcatcacactctactgatttttgttagaacaaggcaatttactgccatctgctggaaatgtaacatacacaaatccgcaatgtctgtaatgtgagtggtaactgccggcaatgggcaccattgtgcaatgcacaacctgcacaactgtacagagcagctctgagtgctgatggtaagaccagaggagcaacagaggaaagtgaggtcctcactgtgtggataagagtcctctgcatgtggggagaccgcaggatggacccaatggtgctgatactggctccttgtattttgcttgctggtggaggaaagatctgggggccaaggcaggggcacaggcctcctccgtcatcaggagggacaaacacctcttctgtacaggcctgggtctcaaaggccaattcaatagagttcataaggaaggcagaaactttatggttctcagtcttgctgacaagccaagaatgtaaattgcctgagagcaggggccacttccacaacatagggtcagtcagatgccccaagaagctcccagactcacacccctggagtgggccttgtcctgagccaggagggcagcctggccagtggatcactcccaccgggtgggacacattggtttcaagggattgtgccatactgggctcccggaatggtgctgatgtgctgacttgggaggattgctcacggcagacacgggacaagctcagggctctgagcccctgcagagccccttttgactctgggacaagagtcgagtgtgtgggtctgtgcatggcactcacccgtctgttctaattacagggccacctcggggccacagtgcttgtggagctcgggtggtggaaagcatccttaaccctggcaagcaaggaggttaccccaactcctttgcaggctctgtgttgcaccccgcttccaagactttccagaccagcagccatggggctttgggattgatctcctctcccatttccaattgatgcggtgatatcacactcatcacacctagaacaatttttttcttacattgttttaccccttttaaataagctttattttttgtatcagctttacgtttacaacaaaattgagcagatactagagagagttcccatattcccctaccccacacaggtacagcctctcccactatcaacctccctgattttaagttgtttattttgggggttttgtttttttgagacaggatctcgctctgttgcctaggctagagggcagtggcatgatcacagctcactgcagcctcaacttcctgggctcaagagatcccgtcacctcggcctcttgagtagctgggaccacaggacccgatagcaacactatacctggctaacttttttttaagagatggggtctccctattttgctgttcttgaactcctgggctcaagtgatcctcctgcctcagcctcccaaagttctgggattgcaggtgtgagccaccatgcccagctaagtttttaatttttttgttatatttttataaaagaaaaataacatcaagacacttcataaatgggtgcagaaaattataacaactaaacacttatatttagtcccatatacacatgtacaatggctggaacagacagaatgctatttttacaaaccatcaggttcttggacaatccaggatttctcaaggttcccagatctctgagaatacctggtggattatctctgggataacacacagaagctgtctgcaaaccttcagatggacttttttttttttaacttttatcataagttcagggggtattagtgcagatttgttatgtaggtaaacttgtgtcatatgggtttgttgtacagattatttcatcacccaggtattaagccttctacccattagttactttttctgatcctctctctcctctcgccctccaccctccaaaagcccccagatgaacatttttatagaagtaacgggaaatacagtgggaatccttgagttgtattttctagggtcagtcttaagctccacaggatgaggggaggatatttcttgcacccacagcccactcccaccacaccctgggcccctcatgattaacattcagcaagatcacatcctaggaatgcagcaatcagtgtctaaaagaaaacgtggctgggagatgtgctgctctacctttatgctataaaatctgtacatttaacatggtcagaaatgaattctcactcacattttactgctttctctggggaagacttgcatttgtggtcatcattgacagaacgcagtcatcatctcgaagagtgtctggaagccagggtccccgaccagcacaagggatgggacagtgtcatgagtaacggtgtcaccagccttaagtaaatggactggggacattcagaggcaagatgagctatgccatttcaatgcaaacagcttgcaaagagccaaagaggttatgagtgacaaccttaacgtaacaaccaggtgacatgtggaattgttttggaatgttgtctttggcaataaatactaggaagctatggtttctagatctgaacagaaagagatggcacctggggaggagaacaactttcacatgcctcaattggaaaacatgtaaatacataagtacctctatgctacttattattctaaatccttattgataaatcactatgccccacatgggcccatacgtcttgtcacacatttattaatcaaataattactacagacagagacctcatataagaatattttcctgggatcccacacaacctagggaaagcccaggtgagtaccccaataaatactgcttgaaggagattaggaaaagaaatgaatgggctcaaataggaaagttggaagaattcaagtatatacatcaggaggaaagggggggagggaaatgagttaataaaacaaataagaattgatcatatgtttcacatttaaaaatagttataattgacccggcgtctcatattttggatagaagagaagaaattcagctccacaccttgtcagaaaaatatagcattgagattcagaaaatacacacacagccggggcatttccctttccaataacgtgttactagttagagtcgacataaccaatagaaacattaatataggtttaaacaagtgtatctcctaggcagatccttaaattcctttaattttacattaggatataaaatcgctcattctaatgggttagtaaatgcatatagtccttcagaagcctcattgatgaaaacacagcacaggcagagggaaatagactgttatttctgctctggctgtatttccatttcctaataacagtaatgaacttgaagcatcgtatttgcacacaaataggtctagattccagtttggctgcagctatacagttaagcgtgtcactgatgtgcacttcccagcctcaaaacacaatttaaagatcactttatggagagtcgaattacagcaatgtgcttaagcattagggctgtggtatttctaaaaactgttggcaacagggccaagttctatggctcataaaagtcgatcacaaagttctgagctactgcagctcattgattgtggttatcctttaagtttcttaatgttcccacccatggtatactggcacccattccatttctcaagctttgacactgttctttccttccttccccttctccttgctcacacgtttacaaacgactgctctgggccatgcccaggtagagtcgtgcacaggtcctaccctccagcagctcagaatgtgcttaggccgacgcgaaaacaagtaagtacaatgtgaatattgatgcgtaccagtcaccatgaaaacacagaacggggaacacctgctgccgcccacctgaactgagccttcgtgaacatgagttcaacaagcaaaccatgggatggggggcaagaaatggcatttccagcagatataaacgaacacaggtacattttaaaacaaagcaaatgcaccaatgcacaatgtcctcaggaaacaggggcgtgataagcgggtggtgtggccagatggtaaaacaggggcggggctggaaagttaaggccggacgctgagtgtcctttactactaagcttaagagttcatactacaggcacctgggggccaccaagaggttttactggtctggctggttgttattgctgctgttgttgttgcttcgagtaagcggaagagatgatagcagtgtggaggacgactgtgacggggtagaaaggtgggtagtggaggccgggagagcagccgaaagtctctccctgcacttaggcacaaaaccccggttctgaatgaagcaactgcaggagaagaggtaagcagctggcttcaagtggtctgtaagcaggggctataccccgggcttggtgtccagatggatataaacagcaagaagaaggtgaaataacggcacaaaatttccaccccaaggaaacagacagaagctgatgccagtctttaaaaactcaggaatataaaaggaaaaactgtttaggagatcagaattaatttgactttggacgttacgtttgcatatccatagggagaagcccacaggccacaccgaggcagaagagactgtgggtgtagaatttgtgagggtcccagggaaagaggagaggagggctcaacaatcgggtagtggtcgtgtccaaggaagccgcagctgagaccctggaaggggaagcctgagttcaagtcagcatggagtgccaacaggctaagccaaaaaacatctcgtgctgttggcaaagggctggcccagaagaaagcgtcgcaggttatgtatgggcctcagcggaactgggccttcccagaaaagggagaagaacgaggtcacaggtgaagagaggaggtgctggcacctgtcagagtggaggcggaggacctgagatttgccttatcagatggggtgggatgggatgagctcaactgaagatgcaccaacaagataggcaccaaggccaggcacagtggctcacaccttaatcccaacactttgggaggccaaggtgggaggatcacttgagcccaggagtttgaggccagcctggacaacatggcaaaaccttgtctctactaaacattttttttttaatggtcgggggtggtggtgtgcccttctagttctagctactctagaggctgagatgggaggatcacttgagcccaggaggttgaggctggagtgggctgtgattgtaccctcaattccagcctgggaaacagagtaagaccctgtctcaaaaaaaaaaaaacataaaaataattaaaataaaatatttaagaagatgggcacctaaagggcaaatggaaatgagtctggaattcaggagaaaagtcagaggaacagggacaactacactggttcccagagtagtttaaagaaaaggtgttctggatgtataatcaggaagaaaagttgcatttttcagcaaaatattgacatcaagtatttaattctttcttcatatataataaagataccaaggaaatctctttgtgaatctatatgatttcagttttaattttaaataatatttagtaataaagaaagtactcagatgattataaactaataatcatttttcaaaaaaaaaaaaccatgttccaattaattttatgtagatgtggtttatactgaatgggctgtcttggaatcaccagggaaggccagcacgggcaccaggaaagctaccataggtggcatttaccttggtgaattctccatggtctgatgctggcctctgactgggcaccccagaagcttgatctgtagagtatgactcatgctaacaaagcaatgatgtctaaaactaaacctggacttggcagttcacaacagaaatacaatcgtcaaatggcctaaataccctgtttagtgtagccactgcattcttcctctatggggaaattggggaggaaaactatgaaaaggttacctggggagcaaggagccggttcccatgagcaacctggtctctacatgtggtagaaacaggctggtagaaatagggggttttggtggggttttttgtttgtttgtttgtttgttttttagtcagggtctcactgtcacctagtctgtaatgcaaaagtgtgatcatagctcactgcaaccttgacctcctcctgagcttaagtgttcctcctgcctcagcctcctgagtaggaactatagacatgcactaccacacctggctaattttttttttttttttttttttttttttttttttgcagagatagggttttgccatgttgcccaggctggtcttgaacccctggcttcaagccatcctcccaattcagcctcccaaagtgctgtgattacaggcatgagccactgcacctgacaggctgaggatctaatgcacccagaacccccaggtcacccacaacctaccctttgccctggacatatttgtcttcctatctccttactctttgttccacccctgactagatctctgttttctttccactgaatcactccctaaatcctgtactagcacattcatcttcaagagtcttcagtgctccgtaaagccagcagaataaagctcagatgcttccacgtggctgagaccgggccacttcccagactcaccacctcccacatcagtgcacatgccccatttaccacaggtggttggtgcttctcccactctgtaagctttgagttctcatttctgtgaacttgtgttattggttcacattaactatgtaccttcactgtgcaggtaccatgctagagtatgcatatctatttgtgcatccagtccccaaccctgggaagtccgtaccatcatcatacccacttgacagatgaaaacacagaggcttggggaataaagacacttgccatacagcaatcgagagaggtgcaagcctggagtctgcgtgctggaagattccaccacacataactgcttcccaaggcactcacacatggtctgcacttcacagtgtttgtttatcaatacacgaagagtttatatttgtactgtggaaaaatgtggatcagaataaagtaagcaacatcttaaaataaaataccttattattttaaagaacaaacatttttgatcgggcgcagtggctcacgcctgtaatcccagcactttgggaagccgaggtgggcggatcatgaggtcaggagatcgagaccatcctggccaacgtggtgaaaccctgtttctactaaaaatacaaaaaaaaaaaaaaaatagctgggtgtggtgacgcacgcctgcaatcccagctactgggggtgctgaggcaggagaatggcttgaacccgggaggcggagattgcagtgagccgagatcacaccactgcactccagcttagcgacagagcaagacaccgtctcaaaaaaaaaaaaaaaaaaaaaaaagaacaaacatttttgaacaagtagtaaatgagatcaagactcttacctaactttaaaacctagttgagtttgtcttcttcagcataaatgccggctctaccacaaaattgctgggtgaccttgggcaaattgattaccctctctgattcatgttcttcatctatcaaatgggagtaatcatcatgtcccatccattcttcactgatgaagtacccagataacctgggtaccactggcacaagcacttaataaataccagctattattattctacactatgtcctaaagacattgtttattttgtctgaattttaaagtggaaaatccggctgtctttgctcaagcctatttttaaaactcttggggaaattgtaaaatataaagttattaaattaaattaaaatcatgagcttgctttggtcgggtggccaatctttttgttttcttctttgtgtctctgtaggaagaagggcgccactgtatgcctgggctgccatcagcagcattgactcattgctaaaagaggggaaagctcaggactctaaatcctgaatccttcagacagtcctgccatttcccaaacattgcaccaacatcatgaaatactttaaaatcaataaaaatgcatgtggcagaaggcaattattcatacattatctgaaaacaataaaggaagatataccttccattcaattttcaggattatatatattacaggtgagtatttttagcagacttttccccctttctctctttttgctccaactgttagtttcatagggtcagagagagttcagttgtatagagaaagtactaactgctgaatggctctgtcaggctcctgtatttaaggagacagaattgcatattacaagaaaatgattgttcagctaccttttcattaacaatttgtctacaaggagacaggcttaactgcttctattgaagttgggaagcaacaaattgaatgtgttccataaggattatgtcatacttcaaacatatggtgagctacaaacaccaagatatcgtatttggaaatagtggtgggttcactattgtttggtggctgtttaattgaatagtcataaataatactttttttaaaaaaacttgtcatctgcataatctcaagtgaaatactgtaataattttcttttatatatgtttttgatccttgacacattaaagaaaaatgtcttttctttaggggaaactacactgaaggttattaaggaaacatcagctataaaatgcatcctaggtcagcttcttgtaatggggttccactttggagcacagagaagacatccaaaggtgtggaggggaaaaattctagctgagcccagggttgatgcagaagagctttccctgaatgcaccccgagattgaggtcctggggtcaataggccaaccaggcttccttctgcctctgtctactgaacagaaaatctagtccctccacctcccacccacaatgttccaaactgaatgctcgacattttaacacatcaagtgacaacactaactttagacacttttagaaagcaccatgtcagtgttgggttgtcatcatgtatatggccagtaagtccacaacaggtcaaagccctggaaccccagccatggtttcaaggagtccaggtttattatgtcgtgtctgtgacacatgtctccaccaggaaacccactcttgctcagtaatggaatattattcatgaatgctcactgtatataaagttcataggcttaatgccaaaacaatattctgttttcctacttaatagaaagagatcactaattactagtgcagaaggaaaaatacctaattccacacagaacaaaggatacccatggaggccatgctgggcaaggctggctccaagtgtcagctacaggtgtaaatgcattgatagagaggaagaaggggaaggttgttttctaacaagtttttaaaggttgacctgactgttgttaagattacgaagaaagacactggaacagtcattctcaactcttcaaactcaatgccctctttttataacatgattttgtacatacccctttactgtcttgaaatgtaattcatataaaagataatctaagacaatactcattaggatggctactattaaagatacaggaaataacaagtgttggtgaggatgtcgagaaattggaacccttgtacactgttggtgagaatgtaaaatggtgcaaacctccctggaaaacagtaaggtagtccttaaaaaattaaaaacagaattcccatgtgacacacatcccacttctgggtgtatatccaaaagaattcaaagcagggtcttgaacagatgtttgcacagccacgtcaatagcagcactattcacaatagccaagaggtagaagcaacccacatgtccattgatgaatgaatggataaaaagaatgtggtatatgcatagcatgcaatattatttagtctttaaaaaattctgttacatgctacaatatgaataaaccttaaggatagtgtcctaagcgaaataagtcagtcacacacaaaaaaactaattctatatcattcctcttataggcagtatctcaaggagtcaaattcatagaaacagaaagtagagtggtggtggccaaaggttggatgggaagggtaacagggagttgtttaatgagtataaagtttgcaatgagtataaagatatgcaagatgaaaagacctggaggtctctttcacaataatgtgaatatgattgacactactgaactgtatgcttaaaaatggttaagaagttttaaatatagatagctacagatagatatagatattaacctgttttatgttactataacaaaataccataggtaattagtaaagaaaagaaatttatttctcacagagccctcgtgacctaatcacctcctattatgctccagcctctaaacacatttgcattggggatttccaacacatcaattttgggagacacattaaaaccatagcattctgcccctggcttccaaaattcatgtccttttcataatgcaaaatacatgcatttcattccaatagccccaaaagtcttaactcattccagcaccaactcaaaagtccaaagttcagtcttatctgaatcagatatgggtaagactcaaggcacaattcatccccaggaaaatccctctgcaatctgcgagcctgtgaaattaataaactgtgtgcttccaaaatacagtggtgagacaggcataggacagacattcccattccaaaagggagaaataggcaagaagaaagacgtgattggtcccaggtaaatccaagactcaacagggaaaacatcaagtcttaaagctaataataatcctccctgactccatgtcccacattctgggcacactgggacaggggctggacctgtaaggccacaggcagccctgcccctatgattttgctgggctcagcccacccggccactttcatgggttggagtctcatgcttccagctttcccaaactgaagttgcatgtggatggccccacagttctgtgatctctgagatggccttactcccataggtcaactaggcaatgtggcagcttggaccccacatttcggctcagcattgccctagtaggggctgtctgtgttgtctccacccctgggaaaagtttcagcctgggcccttgagctgtcaaatacatcctttgaaatgtacagaccccacagtttttgcattctgttcatctgcagagtcaacaccacatagatgtcatcaagacttactgcttgagccctctggagtggtggcacaagccatacccggacccatctgagccacggctgggacagctgaggagtgctgtgcctgaatgcagggagcagagtcccaagcatctctgagcagtgaatgttgaagtcccacggcaaccttcctggaaaccttctctggaaggccctgttctgggcctgtgatgggaggggcaacctgctgagcccatcaaatgcctttgatgtcttttccccattgtcttgatgaatggcacctggctcccttctatccatgctaatctctttagcaaacagtctcttggccacactcttagtttactctcctaaacatgccttttcactctttacatgaccaaggctgctcatttcccatatattttgttctgcttcccttttaattataaatgccatctttaaatcatttctcttcattcacatcttactatatgtggttaaaagtagctatgcagttcctccagtattttgcttagaaatttcttccaccagatatccaagttccttgctcttaaattctacctcccataaagccctcagttgtggacatgattcagccaagaatttataatagttctttgtgaatttataacaaagatggcctttactccagtttccattactttgtttctcatttccatctgagatctcatcagattagcctttaccatatcagaaatgttcatatttctaccagtattttgattaggaccacttaagtaatctctaagaagcttcagactttctctacaagtctctccagaatcatgcttaatggtctgttcacagcaatataggctgttgcttgcctgctcctccacattttcccagcatctagccattacccagttccaaaggtgcttccacattttcaggtatttattatagcaacagacctacttctcagtgccaatcttctttcttggctcattttttgtggctataacagaaaaatacagactgggtaatttataatgaacagaaatttatttggctggtggttctgcaggccaggagtccaagagcatggcatctgatgaggacttttgtgcagcatcatcccatggcagaggtgaaagggcaagaagtattgagagcaaaagatcaagagggggccaaaggttttgtaacgaagtcactcttatgataactaacccactcctggaataacaacattaatccagtcacgaaagcagtccttgtgacttaatcaactcttatgacaccctacctcccaaaactgttgcactgggggttgacaacacataaactttggggaatactttcaaacaatagcaatataaatacataaattctaacacaaatatgattttagaaataacacaataccccaactgaaataaaaacgtaaaaagaaatttatagtataatgtgcatagaaatgtacattatacacatttagcacagaaatgctcagaaaagccagcactggaggttgtaatgcaggagtcaggtgcttgctgctgtccttagaatcttcaagaacatgacagccacagaggcagacggacagggctgggctccactggtaagttaaccaccacaggtgactttctaactccagtgaagttccaagcaaaaggatttacacaatggtttctttcctggaaaatttagggtacatcacaactattggaatacaggtttacccacatgaaagtcccacagtacacttaaaaaattattcaatgggcaatactgccccatgaatgcaggatatagagtgttcccaggccatgcctactaaatgcaagcaaagcccccaagtctttgtcacaatcaaaactgcccctccaaattccataatatagcaccccccagggagaatcacccctagaggaagcagtgagaattgcctcactaaactatgagatccaaaaagaaaatcaaagaatgaagccttttattcagggctctgtcacctgccaatcaaacagctcagggcccaccccaggccattgcccaggggagatttcaccaggtcttagaacacaagcaaagattcatcttagcaaatccatctcagaacagaacacatggatatagggaggggaacataacacacccgggcctgttgaggggttgggggaaggggagggagagcattaggaaaaatacctaatgcatgcagggcttaaaacctagatgacgggttgataggtgcagcaaagcaccacggcacatgtatacctatgtaacacacctgcacattctgcacatgtatcccagaacttagagcaaaataaaaataaaaactccatctcagaacaaaagttggattttggttcttaatttttttgacattcatttatctcctcctacacatgttctctgtcctaaagaattgggtattttaaagttagctttctggagttttattttacttaagactcttgaaaataaaagtttcaggctcaaaggagcgaagcactaatggtgaaaactgatgtcctgttagatttctgagagaatcatctctggtcttcctgatgaccccaaataatcccatgcctggagccacccattctgccaagatcttggcactgattccggactgaacactaacgtccatgtattttcacttggtgattggcagctcccttcttgctttgttgcattatgcagctgcctggaggctcaactgagccaccactgctacaatggcacacccaccttctccaggttcctctggcccatagcacttacctgcattcagtggaaacagaaacaaaaggcctaaggaggaatgatgttgtcagaggtgttcgaaccaaagcgactccatcttgaatactggctgggtaagacaaggctgagatctactggactgcattcccaggaggttaaggcattcatagtcacaggatgagataggaagtcagcacaagatacaggtcatgaagaccttgctgataaaacaggttgcagtaaagaagtcagccaaataccaccaaaaccaagatggtgacaaaagtgacctctggtcatcctcactgctcattacatgctagttacaatgcattagcatgctaaaagacactcccaccagcgccatgacagtttacagatgccatggcatcattaggaagttaccccatattggtctaaaaaggggaggaaccctcagttccaggaactacccacccctatctctgtaaactcatgaataatcctcccttgtttagcatattatcaagaaacaaccataaaaatggccaaccagcagccctgagggagtagtctatagagtatggagtagccattctttcattcctctactttcctaaaaaacctcctttcactttatggactcaccacgaattctttcttgagcaagatccaagaaccctctctcggggtctggattaggacccctttccagtaacaatgtcacaaagaaaataatacttaaaacaccaatcagacactcattaacatattaactacatgtcttgcacataaggagaggggcagtgggcttcctcacaggaataagactgcataagaaagatgctttagaggttcttatgtcagccagttctccctgtactcatgtatttaacatacatttactgagcacatactgtgtgctggtactaaaacaaaaaacttattacaacaataagacccagtgcccatgtctacacagttccaacttggggtgccggctgccataacagagcatctgactgccgtaacatcatcttcaagaacactgagggtaggataaagacaggagttagctgttggcagtgaaaatgtccccaaaaataaaatgtctgagatcctgagataatgagggcaaaggggttttatgtgcctgcatgacagaaaacattaaaaactgtaagcaagttttgtgtctagacagagccaagtcgagtctaggaaccattatttgatacgcaattttctacttagcagcacaggtatgcagaattcaatttgggagtgatctgtattctattcagtttccacaatagcattaaaatgtactcaggaacaggggaatttatcttcctgcaaattcactccctaggggtcctgtagctcaccaatgggtttcagtgctagtgaggtgggcggcagaacagacaacagtgagaaattacagccacaaatcgcccgcatgaaccttgctgctggagctgctggcttctgcccgctcctgtaattgcagacccaaaaccactgccaaaaaagggataactaacctgcaaaaaaaaaaaaaaaaaagcttcgccagctaaccaaggaggtggcctcgctctagtctagagcagaaaatcttcttttctaacatatttccttgagctaaaacattttaccatttcaccacattttatcatttctaacatttgtattatgttttgcagtcaagttgtatttgttatatatggtagtatttctttgtttccctgccaaaaatactcttattaaattgataatgcattttacaatcagtgtgctagtttagaatcaaggaaattcaataattaccgtgatttaaaatgcctttccatagaacaactagaaacaaagctaagaggctaagcattgcttcccacacacatccatgtaatcaaatgtcttttgttcacatctcatcagccacccagaggttcaacttttggaagccccagggaggtaagtcttcccattaggcctaatccacaccaaagccccagcaaggcacgtcggctggccatgctttccctaggtagaaggcagcccgcctctcattagtcttagggtacactcaaagactaagccaggtggagtcaaaacccctgcactcatccccatattccaattgtcaattttaagaaaagtgtggccctggcaccctgacttctgcctttccacagccagtggggagagtgagttagatgtgccagggccagtgtttgtcccagcaaccccccagtgctatagacagctcagtagcagcctcctcattcagcaaacgtcatgaatacccaggaagaattatacatttcaatgattccattctgggatgtcgctagttcactgggaatccctcactgcttgatagttacctttaacctctcaagtacttgttcattgctccttcatggcttttaaatttgaggtctcccatctggggccccgaaggggctcactaagaaagaatcaatgatgataagctgtaaacatttcctttcaaagtcttgatcctagaacaaggtagaatgtttttcttttcctaaccactctaggatcttcacgaccagcagctaaatgtggaacaaggttcagagagctttaggaagcacaagaaacatcactagctctggcagacaagcctgcaaaggccaggggtgacttgagagctgagtcttggtgaatccacttaaggagctgttaatagcccagcagtaactcgaaactgccaagaagcgtccattctccatgggatcttgttgaagccagacatctgtcaccacacctacagtagcaactgtcaaagtgagcagtgagaagggaggaatgcaaaaagcagatcgtgtcaggaaatgcagttttactggtgggggggcgaaaaaaagctaaaggaaaatagaaggctaatatttgggagtcaaaaaacgccaactggatgctgcaaggtacacatggaaaaggagcctaggaacaaaagccacccagcaactaggagcagccagatggggctatcgcatgacaacaaatgtctatgtattaggtgctgaaatttagagatttacttgttacagcaactactgtggccctaaatgagattttgcatcgtccaggcgcggtggctcacacctgtaatcccagcacttcgggaggccaaggcgggcaggtcacgaggtcaggagatagagaccatcctggccaacatggtgaaaccctgtctctactaaaaatacaaaaattagctgggtgtggtggcgcatgcctgtaatcctagctactcaggaggctgaggccagagaatcgcctgaacccgggagtcagaggttgcagtgagccaagatcgcactactacactccagcctggtgacagagcgagattctgtctcaaaaaaaaaaaaaaaaaaaaaaagattgtgcatcaggtggggcacagtcactcatgcctgtaatcccagcactttggaaggctgagatgggaggatcacttgagcccaggagtttgagaccagcttgcacaacatagcaagaccccatctctacaaaataatttttaaaaaatagtccagcatggcagtgtgcacccatggtcccagctacatgggagctgctccatccaatgaagccatctgcatctagtcactctccagcccaaactcatgcctttccattattcctgaatctcatctttttctacaaatatactatgcatagatgtgttgcatgtgtgatttagatctttttatattgccttgctacactatgattgatgcataatcttttttgttgttcttaagacagggtctcaatctgtcacccagggtggagtgcagtggcataatcacagctcactgcttctcaaccacctgagctcaagccatccttccatctcagcctcccatgtaggtgggaccacaggagcatacaaccatgcttggctaattttttttcttcttttgtagagacaatgtcttaccgtattgctcaggctggtctcaaactcctgggctcaagcaatctgcccactggcctctcaaagtgctgggattaaaggtatgagccacctagcctgatacatgatcttttttttaatttaacttttattttaaattcaggtgtacatgtgcaggtttgttacataggtaaacttgtgtcatgggggtttgttgtacagattattttatcacccaggtattaagcctggtatccattagttatttgtcctggtcctctccctcctcctaccctccaccctatgaaaggccccagtgtgtgttgttcctctctatgcatccacatgttctcatcatttagctcccacttataagtcagaatatgtggtatttggttttctgttcctgcattactttgctaaggataatggcctccagctctatccatgttcccacaaaagacatgatctcattcttttttatggctgcatagtattccatggtgtatatgtaccacattttctttatccagtctaccactgatgggcatttaggttgattccatgtctttgctattgtgaatagctgatgcacaatcttaatgaaggtctctaagttctctaagcctcaatgtcctcattcataaaatgaagatactaatagcactttacaagtttgttgtgatcattaattaggaaggaggagttgggaacatgaacctggaacattataattcttttggatttgtttttgcctttttccaaagaataaaggctaagaatgaccaggaacttcaagaaggtaaatcaaatttaacatcactaataacaagaaattagcttgctagaaacagatatgagggaaataacacttttaaacacagctttgttctacataacagggggcattccatctttgagtttttttcttttttagaagtctttagggttgggtccagtggcaattgtgaagtgcaggatgtgaggtagaaaaactattgcttaaaaccagtttctcctctgcctgttgttcacatgctggtcttttccattaaaccaggcatatcctcagaaaacagccaggaactttctggaaggaaggaatgagagcagaagggatgagtacctcctccaggttgggttcctgaaaccttgcaagtggctcacctccaacattctttctccccttcctgctgactggagtgccaatatctagggtgaccttgaaagcaacaactgcaaagccattgtcatccaaagtccctgagtgaccacatggagcagagtcactcatgaacctgaagggctctcctgagaaccattacaaactctgatgtattattcagtgtctctgttttgagctctctttgttatagcaactggtgctaccctagctaaagcaaacttacccaccttagtatccccagtgcctacaacagggcatggctctgttcttaaggtgcttaatgaatagttgtgtcattgaataacccacatacagtatctatacctgggaggcaactctatccagaatttctcccaattgttggggggaaaaataagataaaataaaacatacacctcccattatgaagaaaaagataatctcataaaaaataagaatgctgatgtctgcaagtatctgttccagccatctggagggtacatacaatctagacaatatcaacgcctgaaatagatatcttcatttcttccccagacagtgtctcccttcctttaaggtgcaacgttccaaaataatttgaggaaacctcccctccaccactcattgcatggttgagtgagactgactccacctaccctgcctcattcaagatttatgttgcatctccctagccatagagattgatttggggatggtttgaggagtttggctagaccacaaagtctggccaaggtattaaaattgaatagaatcaaaggtgtgaactcagttcaagattgctttcacttctatatcctactgagatagcaaacagtgcaaaagatattcctaagataaagttacatgtacaacccatgggtttcctagatactgaaagaggcagaatcaaaattagaagtcagtgcagcctttgcagagtgagcaatgcatcaggttagagtcttcagcctggaattcatcacccagaattcatcattttatactatgaggtcggagggctgcatcagcagacaagggcctgagtactaccacagaaggaaactgtagctgtagtttcctattccctacactatgctctatgaggcactgggcctacagtaggcttggccagggcccatcacagtccacccctttgtggggatacagatggacagttctcatgcccaccttgtctaatcactcccagtgtcacaaacaactgttactaggacgcagcatcacacaaaaacaataatgataacccaaaactaaatagtatatgatactaattacagggtaagcccctgctcagaaaaggtcaattacacaaatctaccagtgagtatttccatcttgagcccattggagtatgtgaacatcatttatgaggttactgttatttgtccttacctgaaagacagcatcttgagttttcctagtgaggcttctgtcagtagaatgcgctttcaaaaaaaaaaaaaaaagtgtgttcttggagccttcagctgctcacagatgttgctgcccttctaagatgatgatgtcatgggatcagcagtccttgctgggaaccctgggctccaggtccctttggtgagcccagcccctccaccccagcatcctctgtcatctgaggaaatagctggagggaatcactagctacacccattacaataacccccaccaggagaacactacttcatgatccttgacctctctctgccactcagtctgtagtgggttgagtggaggcctcccaaaaattcatgtctaccccaaaattcacgatgcgaccttatttagaaatagggtctttgcagacacagttagttaagtaacttaagacaaaatcataatggatttctagggtgatccttaagtccaatggctggtgtccttacaagaggaggagacacacagggaagaaggccatgtgaagatggtggcggagactggagtgatgcagccacaagccaaggaatgcctggggccaccagatgctgggaggatcctcctctgaagtcctcagaagaagcatgaccctgctgacaccttgaatctggactcctaacttccagaagtgtgagataataaatttctgttatttggtggcacattattacggcaaacctaggaaactaatatgaaatctgtcttagtccattcaggctgctataacaaaataccttagactgggtagcttataaacaacagacatttatttcccacagttgtggaggctgggctgtccaagatcaaggccctggcagattcggtgtctggtgaggacccgctttctgtcatttcctagatgatgccttctagttgtgccctcacatggtggaagggactagctagctctccaaggtcttttataatcccagtcaagagggatctcccctcgtgacctaatcacttcccaaaggccctacctcctgataccatcactttgggggttagaatttcaacttatgaattggggtagaggggatcacagcattcagaccataaggcagtccatatttcccagaggatcttctcaaactgtgtctgcctcctcagccagcagtgcctcagcaggcaccatacagccccaaatgctgcctcactggctcaggtccttgggcttccaccccttttgtttttcccctagagaaaagtggcaggagcagccaggtggctttatcccctctgccactccaagaacgagtctgacattctgtaaccataccacttcctcctgacagtgggaatcaaccccaccacctcaaaggtgccaggtaactcaaggggatgtgccaggccatccctaggaaggtgagtgctgtgaggcctgtccagagtccagtcttctctgaggaccaggcagcaaggtcccacctgcaaccttacagtgaggtggtagtgcagcctacagtcatttggggaaacattctcccacgctgctcatcaactgttcagcatgctttgactttctctgcccaaactggctatagccagtttgcctatgacaggagagggcttcagccatttaccctcagaggccaccttgtgaatggtcctttttattctgggcagtgggggtcaccctttcccctgccacagcagtctgctttccccttaggtcaagtcctgagatttttagccctccagggaggagtgtggccatcactcgtcgcctgggttaacagcaggcaagcctgtaagtttcacccagcaccttgagacacttacttctgaagcttgcagtatgaacctgggctgtatacccagcaacccagcatcctcacgaagaacaagtgagagtgcagacatgaggacatccgtgcagtgagcacacagctgcatcaaatcgcaccccgccagcccacagcctatggctttggagcagggccctggagtgaggtactacctcttgccacccctgggtgccaccaggaaacaccctccctccagggatgctcaggcagcagccgttagtgtaggcttatttctgacagacccagctgtaatcctagtacaggagccgggctggccacctcgcccctgccactggcacagcaatttcccctttccctacttcgacctggcttagacttctaagtctatcgtccttagatgatacacccactacaccaggagagggccctttccaactcccaggctgtttttgattgaccagatggacaactggatttgagcagaattcagaggtgacagcaataaacccacgattaggcaggggcagcacctgtgggtctgggctccacaccatgcctggacagtgcaattagaggagtgagaggcattgagatgatcctggtcctcaccaggtattaccagcatctgagcaggggctaagcagcaaattccatgtggtttcgtgtggcatggacatgactgggagcagggccagcctgctcctgagacccccctcatgctccagcatggctggctgcccctgcatgttggctgattcacagaagagcctggattgtgcccaggatggcaggtcccatttgctaggctttgtccccatgactagagggcaggtgtcctccaagtttcacctccagaacctattccaagatagttgttcctccctccactcctggcccaagggaaggtgtgctgagtgctcaggtgactcttccatctcagcaaacccccttccacaggccctcatgcccccatagaggaccccacagtgcctgcagctcaggaccctcaaatgccctgggctccagtcaggcctcccaggagacagggctcttgcctgtatttccctctttcctcattttccacataaacttgaagttcttcttatcaatacttttaactatgccaaaagctagccctaaccatgctgtctatccaggcttaaattttggcaagaataaggccagggtcttattgaagattgctttcactttggtttatcaccaaaccagccaacaagcagtggtgagtacacatgagataaggacacaaaggaagtcgagacgctccccgcggccccacagtctctcctgaagatgggcctaacgtcatagtcagcatctgcatggagtggcatggggtgagcattgcccaggtcacagacgctcagagccttgggctccaggaggccaggagaggggccatgtcagcaccaagggttttcttgccactgtaaagagggccatcactgcactcatgcttcctctttcctggtctagttgtcccagagcaggcctgtacaacctcccaccatacatcataaaagtgacagagaatacttgttaaatgctacatgcatacgtatgaatgcactgaatcattacagcaattgttattactcctattttccatatgaggaaactgaggcacagaaaaattcagtgacttgcctagtccagctctcctcaggcatggagaagagggacaagtgagtcctccagctgttagtctggggcaccacagcatgcatcctgctttcagaaatctcctgatccaaagacgtgctctttcccaatcttcttgaaatgcccctaaacttcaggaagttatgtccaacattctctctctcatgaagtaaaaagagggctgctgaagtcagccaacaaatttggcccctccccagtttttgctttgacgtccctcccctagtagagagaaggaatacttggtcctttcggtttcctccacaatcttcatcttccctggcaaagtttccactgagcccacccactgaacatggccagatgatagccacaggtctgagcccacccatcgaacatggccagatgatagccacaggtccagctagctgtttgaagcctcagatgactgccacaagtaaaatgatgccctgcggtccagcaagggtaaagccttctccagagtacctcttccagaatgttctcataaggttgaacctttcctgggtacgctacgagctacccgagcaatgcaagtgatcaccaggagtggctggcaacaggagatagggagacaggaatgtttgtgttaaaacaccccccaagagattttgacagcaacccacccctgggtaagctccaggaataaaaatgtgaaatctcaccttcccaatctggtcttcgtattttttacttttttctgatgatagaaaataaaatatactcattataaatttttaaaattaaattaaaagtgaataaagtagaaagtggaaagcctctaaagtctagcctcctcaaaaaaaaatcctcaagtaatagatgggtgcatatcttctagagctttctatacctacataaatagatgtaacattgaccacttagccaagctatcatgtgtcttaatgttccagcagtaacatgggcttctaacacattgaaaatgtaaattaaccattatagatacttaaggtgagttgatttttataataatggctggcttctgtatttttccctatagttttgttctgctatctccagcacaactcttcctgttcctacatctccaagcatgaggtaacagttctgcatgagttggtcaggtgacacagattaaactggcccaaccatgtcccagatgacaggaatttgttctgaatactgggatgtcacccgcctgggtgcttgctttagtgagatgacagcatgataccctcaggttgatgacaagtgatggtgcttattgttcaagagaacagatccaggtgtcttgggtgagggaaggaggtcctagaatccagaaattccaggaagtctcttcttcccctattaaaaaacaagtgcacaaggtttgacaggattcatgtgatggccatgggcccagcttggtaaaagcctgccctggagaatctaatgggtcagcttagggagataccacagtgcaatctatgaatcaggaagcaggccctcaccagacactgaatctgctggtgccttgatcttggacttcccagcctccagaactgtgagaactaaaagtctgctccttatgaatcacgcagtccatgacattttgtcatagcatcaaaataaactaagataccgcctctcttgtgtacaaaacctgcctatggacctctcagacctccatgaattccaggctaagaacccctgcctttaattagaggaaaaaatattcagcaattctctgccatcccacacagttgcccaacttttcctgggttaaagtgcactattataaaaaaaaaacctgaaagatgaagaactaaaatgaagaaacagctctcactaggagaacaccccatctaacatccataagtaagacatgttttatctgtacggttgccatttatttttctaacttaggtaattcatctgaacatatttttcttttcatttccagtcagtatatgaaagaagttttagcttcataattttagttcttggggaatttggtaaaacgtactagccatcatattcttgggttgaatcttctccatagcaataaatctcagaaaaaaataaaagaaagatgatgcactgcatcatttctaattccaatactatttctggtttaacatatgacttttaggtctttgttaacatttttgtctagctttgtgcaaatagatgggaaaatatctaatgtggtacaaaaatataactgtaaaataaaagctctaggtaaagccataagcaggaataatcagctacaaaaatatctctcaagttgaataatagagttttagctcaactatcaattttgaatacaattacagcccagtagttagcagatcattcagaaatggatattttactgttctacttttcaaattacaatgtggaacttttagcaataaagggcagtttgaagaagtgaaaagtcataaaatgggaaatggaacatatctagcaggagtaaggggaaaagggaagtgtgaggagcgtttaatggggctggcatcactatggctttaggaagagaatcacttctgatctgaatgtcccaagagattgggtaataaaggaatgctggatgagttcaatttaaaaaaaatagagtaaatgctctgaaatgaatattgaggagaaaaatgcacactatgtctgctaaaattaaaattagtattggtaaattggaatcatcaatagaaaaatgctatgccaactgcaatttaaggatatgaccacctggaagcaaatacatactcaagacaagttcattaaagtgattatttctctaaatctggtaaaattcctatccagaagatattccctatgctccaagccaaaacagacaaagttgggctcaaaaacatctcctatctcacacaagaaagaaattttaaaatttcagttcattgaggagggctgaagtctctgagggagacactatctctaacctccaatgctctgagcaaacctaccatttgctccagaagaagacagcatccctatcttgccatacaaacagccttgaaaagttggtccagaacaaaggctgtcagtgctgcttttgcaaagacattcagaaacgcaaatgacaattgcactgacacagagtcctcttcaacagcaataggtgtcagaagacaatggaacaatatcattgacgtaataagaaaaagcttagaattttatcccctcaagagtgaaggcaacataaaagtattgtcagataaatgtaaccattataacgagctatcaaaatttggggatatatggctgggtgcagtggctcacacctgtaatcccagcactttaggaggctgaggcaggcggatcgcctgaggtgaagagttagagaccagcctggccaacatggagaaaccctatctctactaaaaaatccaaacatgcacacctgtaatcccagctactcagggggctgaggaaggagaattgcttgaactcgggaggtggaggttgcagtgagctgagatcacaccactgcactcaagactgggtgacagagtgagactccatctcaaaaaaaaaaaaaaagtggggatataatcataaagcaactgaaaattactaatttctgcttctcattttccctttaaaactactagtcgacaagtccttctacttctggataaaaacagccctgtgaattttctgctcactgtgagaatgaaaaacttttaaagacctaaatcacaaaacaaaacatcaatttcacattttaaatattcaataagcatcaaaattcaaagtttgattcccagttgaagtttttctccctcccccaggtcagggtgttgcaggtgaaaaacttgtagtcaaggaagagggtagcataggctcttctcctttccccagctgtacttctatgcctcctccctaaatatggcttctgatccctccaggtcaagcagaaaaaagaagaggcaagggcagcaggaagtctcccactgactagtatggggaagtgagctagcatctgtgctctcagggttgtgcaagtgtttatatctgactctttttgtcatggtgctttcaggggtcttctgagacttccctctgccatccataaaaactattcatgaagttcccttgatgagcatgagtcttttccagcaggtaaagaccctttcatgtccatcaagagaactacatgagactttcctgctcatcaagggaactcctggagaccccttctctggtctctaggaatatggtgagacctccattttctctcttcttggagacaattttcctctccatgtggcctcttgggcaagacttaaaaggccacacactggctttcttaggtatatagtccatatctagtccacaaaatgcattcaaacatcctttgcctccacaaactctgggaaagtaatgatcttccaaagacgccctctcccttgttgccaaaagccacattagcctgtcttagcattgcagtatcaccaacctgactcagtcaccatctattctatcttccaaaatgcaaggcattcatactactctttttggcagtcctctcaaaatgcttcttaatttgcagttaggaagttatttaataaggtacagcactttccaaaagtaaattatgatcttcaaaactcttcatttgatttttattcttccgtttcttgttctctccaacttctttataagacattgattagtaatcaaatttgaatagagtcaaatctgaatgagtagaaaagttggttttctgccattttgttttacagtcctttggaatatagcttgtgtcatcttcatggctgggaaatgttccattttaccaccttgttacacatcaggtaactcttcctgaagagctatgtattcaagcaggaaaaaaaaatgaacccacagagaaagccttgtatacaaggaacagaaattgataatgtcaataaatttaatcattaattacctcaaagttactaatactgccatttttaaaaaggatgggagttcccagttaaacatgtgaattaaacagatttatttatcttgatttgctattaaaactccactatagggacaataaagacatttttaaggtcataaatacacaaggacagtggggaaggcaatgacagctgaacagagatatcaacaaaatatttgaagccagaaagcagatgtatgtgtataacgaatttaaaagagcaacggaaactgaaattgatgtgcttatgagtgagaacatgaaaaagaagcaagctgattcaatacacacctccaaagacaggaattgggggcacctttgccgacagggcttggagacaaggatgaaaacagaaaacttggttggaagtctttaaaaaggcctgtagacatgaagtttctctttaaccccagataaccaggcaactctacctcccttacattggcagtacactacagctttgcagctctgacctcagtggcactgctgaaaacagaggtgagacccctactgaattaggggattcagtgcaagtgtaagtcctgagttgagaccagcctccttctccatttatctatcagattgctggaagtaaggtttctgaactccagtaagggacaagggtaacccaggaaaagtgacagcacagtagcaagatctgcagacactgacatttgaaggctcccagtgaaatgaccatgtcactgcatactcaccatgaagtcaacaagctccgtcaatgcacagagtcccaattaccccatcttaaaaaatgagccaccagtttttcctaagaaaactaaggaggctttccttatatatttagagatccttgtctagtggtttatatttattgctacagtaaccctgcatggcaaataaccaccaaaccttaccagaacaaggatttgcttttcttttccacagatccacaggtcagccatagttgagctaggctcacctgggctcagggggacactaggcactagaaatctctgccacgtgctctttctcaaaggctgcagttgccgggcgcagtggctcacacctgtaatcccagcactttgggaggccaaggcgggccgatcatgaggtcaggagttcgagaccagcctgaccaacatagtgaaaccccgtctgtactaaaaatacaaaaactagccaggcgtggtggtgtgcgcctgtaaccccagctactcaggaggctgaggcaggagaatcgcttgaacccgggaagtggaggttgcagtgagtcaagattgcaccactgcactccagcctaggcaacagagtgagtctccatctcaaaaaaaaaaaaggctgcagttgatacagtataaatcaataaaaggcaaaacataaaatctagcaaagaaaaaggaaattcctaggatgctaacagttggaagtacaagcccaatagctgtaatgcaataagaatagagtggctatagtcaataataacttaactgtacattttaaaataactcagtgtaattggattgtttgcacctcaatggataaatgcttgaagatatcaatacatgtgattattatggcttgcatgcctttatcaaaacatctcatgtaccctgtaaatatatgtacctactatgtacccacaaaaattaaaaacataaacaaatcacaggaatagaaagcaaacagacctactggaacaggaagatagggcttattttaacagtttgaactaatggaaacttgaaataaaaggcctttttataaaagagctggttgagagtgtggaaagcgaggaatgagaaaagatgcaagggaagaagaaaacaaacaattcctaatagaaggaactaaaaaacgcacaggaaaggaaacggaatcactaaaaaattatttggctcatctgtgaacaggatttacatagctaaaataaaacgctgaatatgcgaacccttctatccctaaatgtggaaggtggaggggaaattatatataaacctaaacatgtaatatctataacctcatatatacataatcaacattttacagagagaagatgtgacgaggggaaatgcaggcatgtgagggttgtataatagtatggcaaagctaaatcctgatctttcatagtataaagtcaacagtaataaaactgtaacctaaaactgaaaagccaagaaatagcattatctgcatcatatttagaattatagagggaaagacatgagaaaacagcaacaagaatagaaagtgtttgctgatgggagtggtaaaagatggagaaaaggaacacctttttcattatataaattatgcaaaatgctaattgccttatgtaaaaattaaatttaaaaaaagcaaaattaaaaccccagacaaaagtaataagctgggagggtatcaatgagtaagcaattttttgttgttgttgttttactagggaggaggaagaaaatacagaataattctaacctctgttagaaaaatgtatagtcggaggtggctggcaagatggctgaatagggacagctccagtctgcagctcccagagagatcaacacagaaggcaggtgatttctgcatttccaactgaggtacctggctcatctcattggaactggttagacagtaggtgcagcccgcggagggcaagcagaagcagggtggagcatcgcctcacctgggaagcacaaggggtcagggaactccctcccctagccaagggaagccattagggactgcaacgtgtactccagcccagatactacacttttcccacgctcttcaccaccgacagacacgagattccctccagtgcctacaccaccagggccctggatttcaagcacaaaactgggtggccgtttaggcagacatcgagctagccacaggagtttcttttcataccccagtggcgcctggaacaccagcgagacagaactgctcacacccctgaaaagggggctgaagtcagggagccaagtggtctagctcagtgaatcccacccccacataccccagcaaactaagacccactggcttaaaattctcaatgctccagcttggtggagggagggacatccaccattactgaggcttaagtaggcagttttcccctcacagcataaacaaagccaccaggaagctcaaactgggcagagcccaccgcagcttggcaaagccactgtaaccagactggctctctagattcctcctctctgggcagggcatctctgaaagaaaggcagcagcctgagtcagggacttatagataaaactcccatctccctcggacagagcacctgggggaaagggaggctatgagcgcagcttcagcagacttaaacattcctgccttccagctctgaagagagcagcagatcccccagcacaacattcaagctctgctaagtgacagactacctcctcaagcaggtccctgaaccccatgcctcctgactgggagacacctcccaccagcagtcgacaggtatctgatacaggagagctctgactggcatctggcgggtgcccctctgggatgaagcttccaggcaaaggaacaggcagcaatctttgctggtctgcagcttccgctggtgatacccaggcaaacagggtctggagtggacctccagcaaacactagcagacctgtagcagaggggcctgactgttagaaggaaaactaacaaacagaaaggaacagtatcaacatcaacaaaaaggacatccactcagagaccccatccaaaggtcaccaacatcaaagaccaaaggtagataagtccatgaagatggggagaaagcagcacaaaaaggctgaaaattgccaaaaccagaacgcctcttctcctgcaaaggatcacaactcctcgccagcaagggaacaaaactgcagggagaatgagtttgatgaattgacagaagtaggcttcagaaggtaataacaaattcctccgagctaaaggagcatgttctaacccaatgcaaggaagctaagaccctgaaaaaaggttagacaaattgctaactagaataaccagtttagagaacaacataaatgaactgacagagctgaaaaacacagcatgagaacttcgtggagcatacacaagtattaatagccgaatcaatcaagcggaagaaaggatatcagagattgaagatcaacttaatgaaataaagcatgaagacaagattagagaaaaaagaattaaaacaacaaacaaatcctccaagaaatatgggactatgtgaaaagaccaaacctacatttgatgggtgtacctgaaagtgacagggagaatggaaccaacttgcaaaacatacttcaggatattatccaggagaacttcaccaagacaggccaacattcaaattcaggaaatacagagaacaccacaaagatactcctcgagaagagcaactccaagacacataatcatcagattcaccaaggttgaaatgaaggaaacaatgttaagggcagccagagagaaaggtggggttacccacaaagggaaccatcaaactaacagcagatttctctgcagaaacgctacaaaccagaagagggtgggggccaatatttaacattcttaaagaaaagaattttcaacccagaatttcatatccagccaaactaagcttcataagtgaaagagaaataaaatcctttacagacaaagaaatgctgagagattttgtcaccaccagacctgctcctgaaggaagcactaaacatggaagggaacaaccggtaccagcaactgcaaaaacataccaaattgtaaagaccttcgatgctatgaagaaactggatcaactaaggggcaaaataaccagctagcatcataatgacaggatcaaattcacacataacaatatcaaccttcaatgtaaacaggctaaatgcccaaattaaaagacacagactggcaaattggataaagagtcaagaaccactggtgtgctgtattcaggagacccatctaacatacaaagacacacacaggctcaaaataaagggatggaggaatatttaccaagcaaatggaaagaaaaaaaaaaagcagtggttacaatcctagtcactgataaaacagactttaagccaacaaaaatcaaaaaagacaaagaagggcattacataatggtaaagggatcaatacaacaagaggagctaactatcctaaatatatatgcacccaatacaggagcaccaagattcataaagcaggtccttagagacctgcaaagagacttagactcccacacaataatagtgggagactttaacaccccactgtcaatattagacagatcaacgagacagaaaattaacaaggatattcaggacttgaactcagctctggaccaagcagacctaataggcatctacagaactctccaccccaaatcaacagaatatatattcttctcagcaccacatcacacttattctaaaattgaccacataattggaagtaaaacactcctcagcaaatgcaaaagaacagaaatcataacaaacagtctctcagatcacacttcaatcagcttagaacttaggatgaaaaaactcactcaaaactgcataactacgtggaaactgaacaacctgctcctgaatgaccactgagtaaataacaaaattaaggcagaaataaataagttctttgaaaccactgagaacaaagacacaatgtaccagaatctctggcacacagctaaagcagggtatgagggaaatttatagcactacatgcccagaagagaaagtaagaaagatctaaaattgacaccctaacatcacaattaaaagaactagagaagcaaaagcaaacaaattcaaaagctagcagaagacaagaaataactaagatcagagcagaactgaaggagatagagacacaaaaaacccttcaaaaaatcaatgaatccaggagccagttttttgaaaagttaacaaaatagatagaccactagccagactaataaagaagaaaacagagaagaatcaaatagacacaatgaaaaatgataaaggggatatcaccactgatcccacagaaatacaaactaccatcagagaatactataaacacctctatgcaaataaactagaaaatctagaagaaatggataaattcctggacacttaacaccctccgaagtctaaaccaggaagaagtcaaatccctgaatagaccaataacaagttctgaaagtgaggcagtaattaatagcctaccaaccaaaaaaagtccaggaccagacagattcatggccgaattctaccagaggtacaaagaggaactggtaccattccttctgaaactattccaaacaatagaaaaagagggaatcctccctaactcattttatgaggcgagcattgccctgatacaaaaacctggcagagacacaacaaaaaatagagaatttcaggccaatatctctgatgaacatcaaggcaaacatcttcaataaaatccagcagcacattaaaaagtttatccaccacaatcaagttggcttcatccctgggaagcaaggctggttcaacatacacagatcaataaatgtaatccatcatataaacagaaccaatgacaaaaccacatgatatctcagtagatgcagaaaaggcctttgataaaattcaacaccccttcatgctaaaaactctcaataagctaggtattgacggatcgtatctcaaaataataagagctatttatgacaaacccacagccaatatcatactgaatgggcaaaaactggaagcactccctttgaaaaccagcacaagacaaggatgccctctctcaccactcctattcaacataatattggaagttctggccagggcaatcaggcaagagaaagaaaagtgggtattagaataggaaggcaggaagtcaaattgtctctgtttgcagatgacatgattgtatattaagaaaatcccatcgtctcagcccaaaatctccttaagctgataagcaacttaagcaaagtctcagaatacaaaatcaatgtgcaaaaatcacaagcattccaatagacagccaaataatgagtgaactcctgttcacaattgctataaagaaaataaaatacataggaatacaactgacaagggatgtgaaggacctcttcaaggagaactacaaaccactgcacgaggaaataagagaaggcacaaacaaatggaaaaacattacatggtcacggataggaagaattaatatcatgaaaatggccatactgcccaaagtaatttaaaaattaatgctatctgtatcaagctaccattgactttcttcacagaattagaaaaactactttaaatttcatatgaaaccaaaagagagcctgcagagccaagacagccctaagcaaaaagaacaaagctggaggcatcacgctacctgacttcaaactatactacaaggctacagtaacaaaaaccagcatggtactggtaccaaaacagagatatagaccactggaacagaacagagccctcagaaataacaccacgcatctacaaccatctgatctttgataaacctgacaaaaacaagcaatggggaaatgactccctatttaataaatggtgttgggaaaactggctagtcatatgcagaaaactgaaactggacccattccttacaccttatacaaaaattaattgaagatggattaaagacttaaacataagacccaaaaccataaaaaccctaaaagaaaacctaagcaataccattcaggacataggcatgggcaaagacttcatgactaaagcaccaaaagcaatggcaagaaaagccaaaattgacaaatgggatctaattaaactaaagagcttctgcacagcaaaagaaactaccatcagagtgaacaggcaacctaaagaaagggagaaaatttttgcaatctatccatctgacaaagggctaatatccagaatccacaaagaacttaaatttacaagaaaaaaaacaaacaactccatcaaaaagtgggtgaaggatatgaacagacacttctcaaaagaagatatttatgcagccaacaaacatatgaaaacaagctcatcatcactggtgattacagaaatgtaaatgaaaaccacaatgagataccatcttatgccagttagaatggcgatcattaaaaagtcaggaaacaacaggtgctggagaggatgtggagaaataggaatgcttttacactgttggtgggagtgtaaattagttcaaccatcgtggaagatagggtggcaattcctcaaggatctagaaccagaaataccatttaacttagcaatctcattactgggtatatacccaaaggattataaatcattctaccataaagacacatgcacatgtatgtttattgtggcattattcacaatagcaaagacttggaaccaaccccaatgcccatcaatgatagactggataaagaaaatgtggcacataaacatcatggaatactatgcagccattaaaaaaaggatgagttcatgtcctttgcagggacatggatgaagccagaaaccattattttcagcaaactaacacaagaacagaaaaccaaacactgcattttctcactcataagtgggagttgaacaacgagaacacatgaacacagggaggggaacatcacacactagggcctgtcagtgggtgggagggcaggaggctaggggaaggatagcattaggagaaattcctaatgtagataacgggttaatgggtgcagcaaaccaccatggcacgtgtataactatgtaacaaacctgcatgttctgcacatgtatgccagaaattaaagtataagaaaaaaatacatatagtcaattatagtttttaaaataaccactaaaaaaatggaaatataatctatggatttcaaaataacagaaaggttaaaggaagactatagaaaactttattgattcaacagaaagaggaaagcagcaagaaaatgggataataaacagaaaacagaagccaatatggtagtaataagtccaaacatgtcagtaataacaaataatgtaaataatatagtcgcttatcaagaaagagacttacagtttagatttttaaaaatttaacttaacctacctaaaggtaggattgacagcaaattagagtgtttagcagtggtttttgtgatgcctgaggctatactcattcttcttaaattacctagaatggcaaagatcagtaagtggcctttggcccttcctcaatacatagtaagagcagagatgctgataccccaagaaacaagagcttaaaggccaagaaaagtcatttttttctttttttttttttttttttttttttttgagatggagtttcattcttgttgcccaggctgcagtgcaatggcacggtctcagctcactgcaacatctacctcccaggttcaagcaagtctcctgcctcagcctcccgagtagctgggattacaagcacccgccaccatgcccggctaatttttgtatttttagtagagatggggtctcaccacgttggccaggctggtctactcctgacctcaggtgatccgcccacctcggcctcccaaagtgctaggattacaggcgtgagccactgcgcccggcccccttttttttttttttttttaaagactgagtctcactctattgcccaggctggagtgcagtggcgcaatctcagctcactgcaacctccacctccgaggttcaagcaattctcatgcctcagcctcccaaatagctgggattataggcacccgccaccacgtcctgctgatttttgtatttttagtagagacggggtttcaccgtgttggcaaggctagtatcaaactcctaagctcaagtgatccacccgcctcagcttcccaaattgccgggattacagccgtgagccattgtttattttttaaaagaaaacaaacttgaaaacatacattatctgaaggagaaggattatttaaaaagatacaaaaattttaaatagatgtaagtcaataaaaataagcaatgaggaaaagactccctattcaacaaatggtgaatggtgctgggataactggctatctatatgcagaagaatgaaactggacccccacctatcaccatatacaaaaattaattcaaaggccgggtgcagtgtctcatgcctgtaatcccagcactttgggaggccaaggcgggtggatcgcctgaggtcaggagttcgagaccagcctgggcaacatggcaaaaccctgtctctaccaaaaataaaaaattagccagttgtggtggcacatgcctgtgattccagccatttgggaggctgaggcaggagaatcacttgaacccaggaggcggaagttgcagtgagccgcaactgtgccactgcactccagcctgggcaatggagtgagactctgtctcaaaaataaataaataaataaataaataactcaagatagattaaaggctgggtgcggtggctcatgcttgtaatcccaacactttgggagaccgaggtgggtggatcacttgagcccagaagttcaagactggtcagggcaacatagcaaaactccatctctacaaaaaatataaaaattagccaggcacagtggcatgtgcctgtagtcccagctactcgtgaggctgaggtgggaggatcacttaaaccaggaatgcaaaggttgcagtgagccgagatcacaccactgcactccagtctgggtgacagagcgagactgtgtctcaaaaaaaacaaaagataaattaaagtcttaaatgtaagaccccaaactataaaaatctagaagaaaccctaatatcgtaatactcttctcaatatcggccttggcaaagaatttatggctaagccctcagaggcaattgcaacaaaaacaaaaactgaccaatgagacataattatactaaagaacttctgaacagcaaaagaaactatcaatagagtaaacagcctacagaatgggagaaaatattcccaaactatgcctccaacaaaggtctaatatccagaatctataagaaacttcaaactacagcaaaaaataaataaccccattaaaaagtggacaaaggatatgaacataacagacacttctcaagagaagacatacaaaggccaataaacatgaaaaaaacgttcatcaacactaagcgtcagagaaatgcaaatcaaaaccacaatcaaataccatgtcacaccagtcggaatggcttttgttaaaaagtcaaaaaatagcagatgtgcacgaggctacagaaaaaagggaatgcttatacactattggtaggaatataaattagttcagccactgtggagagcagtttggcgctttctcaaagaactgagagttaaactaccatttgacccagcaatctcactactgattctttacccaaaagaaaataaattgctctaccaaaaagacacatactcatatgttcacagcagcactattcacagtagcaaagacatggaatcaacccaggtgtccatcaacagcaggctgcataaagaaaagatggtacacatgtaccatggaatactacacagtcataaaaaagaatgaaatcatgtcctttgcagtaacatgaatgcagctggaaaccattatcctaagtaaactaacacaggaacagaaaatcaaatactacatgttctcacttctaagtggaagctaaacactggctattcatgaatataaagataccaacagacagtggggactacttgaagagggagagagggaggaggcaagggttgaaaaactactgggtactacgctcactacctgggtgatgggatcaatcataccccaaaccccagcatcaagcaatatacccatgcaccaaacctgctcatgtatcccccgaatctaaaataaaagctgaaattattttttttaaaaaagaaagaagatttagaaaaaaagaataaagttttccatagggaaaaatatatagaagtcaatttcttccttatgctatacacaataataaattttgggtggattaaatatctagctgcaaaaagcaggaggtgttttccccaaggaaaatttctaaagtctatgtaggcagttgcctgctcagactagaatgtatgtcaacaattcagaattacttttttgaagatcccaatctctaggtacatttttaactgtaatcaaacaactcatatatgaatgtaaatcttctcatttgcttataaccaatagcagagaaaagcttgcattggttttgaatcacagagctcgtgagtcagagataggagggttaggctgtgtaaggacgaaaaagtggtatctgctcctcacccattacaagagtcagagctgacactcctatagcaaaatgttaacaagaggaaagcatagcaaatgtatttaataaaaggtctacaggacacggaaaccttcagaaataaagaccccaagacccaggtgagaggtgaagctagctgggtcgggtggggacttgtgggtcaggtggggacttggagaacttttctgtctcacaagaggattgtaaaatgcaccaatcagtgctctgtagctaggattgtaaaacacaccaattagctctctgtggctagctagaggtttgtaaaatggaccgatcagtgttctgtaaaatggaccaatcagcacactgtaaaatggaccaatcagtgctctgtaaaatggaccaatcagcactctgtaaaagggaccaatcagcaggacatgggtggggacaaataaaggaataaaagctggccacccccgcccccgccccagccagcagcagtaacccgcccaggtcgcgttaggcagtgcgtaagctttgttctttccgtctaaacaataaatcttgctgatgctcactctttgggtccccaccacctttaagagctgtgacactcaccgtgaagatctgcggctttattcttgaactcagcaagaccacgaacccaccggaaagaaccatctctggacacacgggaaaaaccgtgtgtttctatgctaaatctgatgaaaggagtggatagttgtggagaaacacaattggataaaagggtatgacctaatgccagtatactaggcggaggggaggagaacctagcaaggcttgtccggatttttcttggcctctctgtgtgttgcattctttcccctggataggggacaggactcctctgtaatgagggttttctaccttcaggggagtggcgtctctaggttttatgacttgctttgcgggagagaagttgtttctatgacttacgcaggaaaagaggaattcttagggaagataagaggaagaaaggagagtgaggtgtcagaaggaccttgcttctgaggccctcccaatctccttcagttcaaagttttcagcacaccaaggttacatagtttggggtaccatgttttaagtccgaacagccattaagaactctggttctgggccaggcatggtggctcattcctgtaatcccagcattttgggagaccaaggctggctgatctttggagaccagcctggccaacatggtgaagccccatctctactaaaaatacaaaaattattcaggcgtggcagtgcacgcctgtaatcccagctacttgggaggctgaggcacgagaattgcttgaacccaagaggcagaggctgcagtgagccaatatcacgccactacactccagcctgggtgacagtgagaatctgttaaaaaaaaacaacaaaaaaacaaaaaaaaaaacacctctggttctggaaccagacatttttcaagcccagttctgccactgtcaattcttgtgaccttgaatgagttgtccaatttctttaagtctcagtttcttaattgttaatatggggataatagcagctgacagactaaatgagaaaatacccacaaaattcacccacagcccagcgcatcctgaactcaacaaatgttagctctcatcattgagccatgggagccaataaagacacatggtctcagatgttgtctggggtctgctgaggagcagaagctgaactcaagctctccaggccccctggggatgcacctttctcactctgggaatgctaccaagagtcctgatttgaaacttgtccctaattcatatggcggctgcccacctggccctgaagaacatccaacagatgcttggagctcaggccaggagtgtggcagccacctcctcctgggcccccgctgctctgtcatctgcccccacccccccagtctactcccaggtcagacttcccaaatcacagctttcatcaacgattgcaattctctactcaaaaacctgttccaggctggggaccgtggcctgtaatccgaatgccttgggaggctgaggtgggcggatcacatgaggccaggagttcaagatcaacctgggaaacatagcaaaaccccatctctacaaaaagttcttaaaaattagccaggcacagtggcacatgcctgtattcctagctactctggaggctgaggtgggaggaccacttaagcccaggagtttgaggttacagtgagctatgatcacaccactgcactccaaactaagtgagaccttaaaaaaaaaaacctgttccatcttgtcttgtgcctgatatcgaggggcttctatagtatggctccatcttactgaaccaatcttatttattcccctactccacatcatcaaacttctccttagaccaattactcttactccctgctctgtgaatatgccaccctcacttctgcctctcagcatttccccagcctgaagtctctcccaatcctctgtctccccaaactgatctagtagcataggtactgctagaacctataggcagaatgtctggaatctgtaacctcccgaaagcattaaaaagaataaaatctaatgtagaaccctctgcttttctttatttgtaaaatattagggtgtatatccacaatactcatcataccaaagcaaattagaaatggatcaaaaatttaaattttttatacaaaaaattggccgggctcggtggcgggtgcctgtagtcccagctactcgggaggctgaggcaggagaatagcgtgaacccgggaggcggagcttgcagtgagccgagatcacgccactgcactccagcctgggcgacagagcaagactccgtctcaaaaaaaaaaaacaatttaaattttttaatgcacaaaaatagttgaaaagaaacatgagcaaattctcttatgctctcaaagtaagtaaatcctttctaagcatgacacaaaattcatcactctacattctttatctgttgtcgattctttttcaccacccctcccttctaaagattcttcattcaatagagaagcaaagagcaccttgcccagaactctctccccacagcacccagtgtggttctgagttatcgtcctccagggagaggccctgtgggggatgagagacagacgagaggagacattattttccagagaggactgggaccagacgcactgggagacgtcagactggcgctcctggccaagtcctgagaagcaagtgcattgcgttgcgtgcggatacatgatgaaagcttcctagagattcccgggaatgagcatgtcggaaccttccactgcagggcttctggctgagatttttggtgccatcttccctgacctttcaggtttttgagtagagaactgcaatcattagccaggcgcaatggctcacgcctgtaatgccggcactttgggaggccaaggcaggcggatcacgaggtcaggagatcgaaaccatcctggctaacatggtgaaaccccatctctacttaaaagtacaaaaaattagctgggcgtggtggcgggcgcctgtagtcccagctactcgggaggccaaggcaggagaatggcgtgaacccaggaggcggagcttgcagtgagcggaggtcgcgccactgcactccagcctgggcgacagagcgagactctgtctcaaaaaaaaaaaaaaaaagaattgcaatcattgatgaaagctgtgatttgggaagtttcacctgggagtagactgggggatagggacagacaacagatgaaggcctgacttcccgaggccttccaaggatgtgtaagccctcactccttttattaaaacctttaacaccagaactacagagagtagcttctattttcctgaccaacgcctgtctgatacatttatcttttgggaatttatcctacggtactctcacacacatataaaatcacgtatatttaaaaaaaaaaaaaaaactcggctgggtgcggtggctaatgcctgtaatcccagcattttgggagacagagatcatctgaagtcaggagttcaagaccagtctggccaacatagcgaaacctcgtctctactaaaaatacacaaactagccaggtgtggtggtgcctgcttgtaatcccagctactcgggaggctgaggcatgaaaatcgcatgaaccctgaaaggcagaggttgcagtgagccgagatggtgccactgcactccagcctgggcaaaagtgagactccgactcaaaaaaaaaaaaaaaaaaatcattatttataatagcaaaagattggaaacagtcttaaagtatatcaatgatgggcaatttaaaatatcatgatgcatccataggacagaatgctatttgccgttagaaaggtacagcgcttcatgtagccatgtggactgatcttcaaggtagggggaaacccacaaaattcaaattagcttacattgtatgccactatttgtacaatgtgtacaataaacaaaggcacagaatatctcccggaatatacataagaaaccagtgagcctgagtgccttgcgaggaaagttatggaattgatgtccaagagtgggaggtagagctacgttactccgtacaccctttttcactcctgaaaattctatcatatggatatatttgccaaaaataaaacaactaattagttataagattacatgatctttatgaaatgccagcaaggcatctatagacagaacaacatactttcttccctttttttatttctcagattttaaatttcttcctgaaacttaaaacaaattagaaataaggaatttgaccttcttgttagagtatgtgggaataatgcctgttggccttttggaagattaatttcctacatccacttacactgcctaaagcatatgccccaacagatgagggagaagctggattgagatttaaatgcttccttgtcttgttccaatacaggattacttaaatttcaaatccatgcactttaacttattgagtggaagtgcctactgtcttctgggtaataaattctggagattgatttggttcttctcatatcttctaatttaaaaagaataaactaaagcagggataaccttgattacttgggaacaaagtccaattttttttaatttgccactactctcatccttgcctaaaaattggaagtccgaagtggataccctccactgaacagtgaccatttacattccaagaacactactaaggctggagctgaatatcatgagtcctaaaaattccagattcactattcacgatcccagagctgtaataaaatatctcacatgattcatcatataaatatcgctattttaactcttctgtaagaccttttctaactattccagcaaaagcctcttcttccttctttaaacccctgtaatattatatataattacagtaattattaatattttggttttatatcacttaaaaaattggccattcaccagtatactcaaatatatttagatggccactttttagtattattactattaatagtttctagactgtgataaagagaaattttctggctacttctgatagttccgcataaagaaaacagatatgttttcttctgctctgtataaaatatctcctgtctttccagttacatgtgtcaataactccacctgcctttttttacttaagtagttttgagctgggtttctcttgaaaaggcaggatccttgacagctcccactcccacccttcttctgttgaaccagaggtgcgtgcagccacacacagctctccttggagccattctcctcactcaaatcccaataaaatagtcccccaaacactgatgataacttctacacctcactttggttgttcttccttcaaattctgcctcaggtgccttcctggcttatccaagtgaaactgcaagggacctaaaccactttcaagcactgaaggaaaagggtatattgcaagagattagggttgaattgtgtcacccaaaaagatatccccatgacctaaccccaagacctgtgaatgtgaccttatttagaattatggtcctgctgggcccggtggctcacacctgtaatctcagcactttgggaggccgaggtgggcagatcacttcaggtcaggagttcaagaccagcctggcaaaaccccatctccactaaaaatacaaaaattaactgggtgtagtggtgcgtgcctgtggtctcagctactcaggaggctgagggggagaattgcttgatccggggaggcagaggttgcagtgagccaagatcacaccactgcactccagcctgggtgatagagcaagactccatctcaaaaaaaaaaaaaaaaaaaaagaagaagaagaagaaacagggtctttacagatgtaatcaaattaagatgaggtcattagtgtgtgtcctaaatccaacatgattggtgtccatataaaaagataagagacacagatacccacatatgtagaggaaagacaatgcgaaaagatgctgggaggatgccacattgcaacagaggcagcgattggagttctgcatctacaagtcaaggaatgccagcaattgccagccctcaccagaagcgaggagaggcacggatgggacagattatctccctcagagccctcagaaggaatcagtcctgctgacaccttgatcttgggcttccagcattcagagctgcgaaagaatgcgtttctgctgtcttaaggcacccagtttgtagtactttgtgacagctgccctgagagactcatacacaagggtgctgggctgccttctcatgctcaaaggcagtatgaacttgtccttgactatcacaagaccaggtggccacacgcagccaggcccttgagcactgcaggctgccttcttttcctctaggctctattcccccttccacatctgcttcattccttcctctctcaacacaactttccagaggggcaaggccattctgtcaacaactccatgctttgtctcttagaacttctgccactacatagagactgattcaactctgtaaacactgggtaaaaaaatctagggaagggcccaatttgggtcaagagccctcttcagccaaccagttgtggcaggggagacatgatcacactgcacaaaatagtttcttgagcaaatgtggcagaagacatcttccagaagcttcttgaggaaagggacaatgcttttagacttcggtgctaccttctccctcatatgcaatccttcccaagagttccctcttcaatctctccccaccccctcacacacacacacacacacacacacacacacacacacacatccttgaggtcctttgctttctgaagtattgttagagagagcaaacattcaaccatacaatggacaaaaatgtattccattctatagaatcttttaagctaatcttaactttttattatagcagtataccagactatattcttagaattttatcaataagctagtggaattacatgtgctaaaagttttttataaatcttattacttaaaaatgtatgcagcaggtatttctccggtcactatacctcgattttacaactgttgatggctgcccttgttcctggtttgtggttcatgtttgctcaagctaaacatgctctaaagatccactggaggactctgccttcttagtatcaattcttcctgctcatctgttgcagtccaaagcgaatggaactgacattgtggatctgaggctcaggcttggctctgatgaatatataacccttaccttactagaggcagccgagtggagagccatgaatggttttaagagaatccatcaccactactgacaaattaacttaaagcatgttcttctgacagagattcaatagcatcaccttttaatacaaagcacagctcagtgattggtgggcatcctcggatgtcagctctacttctttatttactgaaggacaaaacccaatacattgaattaattgatcacaccatacaactgaattctatgaggattttggaaattttccctaccgttaatattgattagatcagtcaaaatagactagattatgccacagtaataaacaattccaaaaattcattaactttaaacattatttctcacccatgcccacaactattgcagattggctggaactctgctccatgtcatctgcattcaggaacacaggctggctcacactctaccatctggaatgtcacagattgcagtgacaggaggaagggaacacggcaaattgtactttagctcttaagggattgattctgcctagaagaaacacctgtcatttctgcttacatttaattggccacgtgagccacatgaccattcctacatccaaggggacatggaagtataatcctgccatgctggaatattggtgaatgtctggagtcctcatgtagctacaatccacctctccagtcaccaaatgatcagttcagtgtttctttcttgagcaaaattcatttattctctccccaggagagacaactcaaaagtctcattcagtcacggatcaagtacctctgggtaatgcatggtactatcttcatcaggagcatgttagtttgctagggcccccataacaaaataccacagaccgagaagcttaataaaactttctcaaaattttggagggtggaagtccaagatcaaggtatcttcaggtttggtttctcctgggtccgctcttcttagcttgcagatggccgtcttctcaccatgtcctcacatggcttatttttctgtgtgcatgcattactgatgtctcttcctcttcttataaagacaccagtcctattggatcagggcccccccacttatgacttgacttcatcttaatgacctcctaaaggccctgtctccaaatgcactggaggttagggctccaacatatgaatttggggggacacaattcagcctgttcaggtgatacccagtcactaaactgggcctgggtgtggctcctcttgttctggagagttatgcagtaaaaagacaagttacctaccccacacacacctaacttacaaagatgaaacagggaacagatgactccaacaaacattcctctttggaaagaggaaaaatgagagatatacagcagacactggcctttagcaactctgaaatagcttgaaccgatattgggaggtctaccctaggtctgaggatgtcagctcagcccttaaatacgctctgtgcaagaagcctcattctccataattctccatggccccagctttcttttccatcatactatctgacacatctaaagtaggcatcggggaatacattttgcttgatgtccatacagctttctcagaccacttccaaccctaaatgtttggtgatccaagggttcttttaagtctttaatacttggaatctcttttaattcagtctggtgattcctttggaggtacatctcttacaacaacttaatctacttcttagcattggatttcagaaaattccaggtgccaacagccacattcatggttcccttcaagacatattgtaatggataatattaggcatcaacttgattgaactgaaggatgcctagatggctggaagagtatttttctgggtgtgtctgtgagggtgttgccagaggagattgacatttgagtcagtagactgggagaaatagacccaccctcagtgtgagtggtaccatccagtttgctgccagcatgactagaacaaagtaggcaaaggaaggtgggattcgtttgcttgcttagtcttctgaatctttcttcttcccatgccagatgctcgcttcctttcctgctgcccttggacatcagactccaggctcttcagcctttggactctgggacttgcactggtggccactcagtgggtcttaagcctttggcctcagactcagggctgcgttgtcagcttccctggttttaagggttttggacttggactgagacacacaactggcttctctcctccagcttgcagacagtcatcatgggacttcaccttctaattgtgtgagccaattcttaataaactctggtttatatatacatatatcctattgtttctgtctctgtggagaaccctaatacacatgtcttatgtggatctttactctggtacatgttagtcttttcagaggttttaataatggtgtgatggccatggaaatatattcagttgaatggtttttaatagtagatatatagatcatgcccttctctgcaaaactcagttttaatattttttattgccaaatggttctctcaattttatcctatactgtttgaaatctaaaatcagattgcgcacagtggctcatgcccgtaatcccggcactgtgggaggccgaagtgggcagatcatctgaggtcaggagtttgagatcagcctggccaacatggtgaaaccctgtctctactaaaaatacaaaatcagctgggcatggggtgtgtgcctgaagtcccagctactcaggaggctgaggcaggagaattgcttgaacctgagaggcagaggctgcagtgagctgagatcgcaccactgcactccagcctgggcaacagagcaagactccacctcaaaacacaaaaaagtaaaaaaataaaaataaaatcagtcaacctttccaacattgcaattctgaaatgccccattaattcctgcttggactccagctgattctttcctgaacatgtcttttgtaataccttgtcaaatgcagccaatagaaaccaatgcacattactaatattgtgttttcctgcctctttccctagagctataaatttattagcatataatctgccttccaagtcactgtgggcaacgttttaaccaaagtttttgtctttcagactttataacagtttcttcactgcctaccacttgtcctgcaagccaatgacaaactgtaattttttgttatgttggcaccccactcctggtagcaatatttgtattagaataagctaaattatactagtaagaaacaaccccaaaatgtccatggctagaaataataaataattctttctgtctcaagttacatgttcattatacatcagctggtgggaagcacagagcagactcagctccacgtcaccttcactaattgatggagttaaccaaagactccacaacctggaactatcatggcaggaagaagtgaatttagttgctgcactagatctcaaagacttcttcccacattttactgaccaaatcaagtcacattgccacacctactttcaagaggttgggaaagtctaatcttacatgtgcctggaaaatacagtatcaaaatagtaaacagtccttatgtttatcaccgtttttttttttttttttagattgaggttcttaagaataagctccaaatgaactttccacaagactacacctaaaaagggaacaccaattttcatctgtgtttctacatgcgtaaggatacctaggaccatttcccgactgatcttaaaaatgcatgttccactggttttgagatgctatgtaaaaccagaattgtgtttcctaatagttttttttttttttaaggtgggtaaaaatttcaacagacttcttcactgcagaactactcaggagcatctcttggagccagaataccttgaaatacactttagaaaaaaaatggctttcattttgaaaaatataattcaataagtgaacttattctgtgttatataataagttttgtttctcaggtgactttaccctgagattggttcttgtggaagatacgatccatgatgtccaaagaattacctataactagagaagatctctctgtgtgttgtggagccagctttagcatgccagagttacatatgctgcacttctgtgacttaaggaggcatctgccggctagtgtaaaaagacttgatgtttccatatagataattatcccatgacagattctctatgctgtctacttctgaccatagatgaggcaactgtgtgagactgagcctcttctcttctacacaatgctgaggttgcccttttcaaagttctcttcccataaagattaccttaccatttgtattaatgagattttattcacttaacaatagaagaaaggtacacctatattccataacctccatgggcctgacccaaactcacctgtgcagcctcattgattctaacctactccacacatcttatctattactggaggctttcttggcttttggccacagtgtaagtaccatgtactggatttctctatggagcacaaggaggttatctactcacttaaagctagttaccattgtgtttatgactttagaaatgcacgactgatttatctcctgatactaaactgcattatgaacaacttaatgtttgacacattttccagaatgaatttcctctctttctgttgtcttgctttatttacttcaagaagaacatcgagagcttactcaagaaggataatgctccatggttatgtcttctctgggagttgcaaacaagactcagtcagcctgccaagcatatgcatatgggtattccaatgtgaaagagaagcttcactgatcagtgaacagaatgaaccacagctgctagtttagatctggctcaaatcagaagttgtgacttttgccatctccaagggctggttaaagctctgattcatgcatgaaccacccagtccatatggggtgggcaacacagcttgagctggaacattctattcaaattttattgagtccaggaaaatagtgcttctcataccaatccatcctcattttttgatgattacatgaatagatgaatagcataatttaaagctacatgcttttaatctctgaagatacaatcagatttgctttaggtaaaatctgcagacagctgcgaaaaatcacccttccaaccaaatgacccatctttatctcttttaaatgaaggcattagtctctggcagtcccctaccttgcattaatatgccctcaggaataagtcatcaagcctatgcttctcaaactttcccactaaggcacccctgacagacagtaaggtgtattagtaagaagagagtatgggtgtattagtccatacctgaaactgggtaatttataaaggaaagaggtttaattgactaacagttcggcatggctggggaggcctcaggaaacttagaatcattgtggaaggcgaaggaagcaagacacatcttacatgatggcaggaggtggtggaggggaactaccacactttaaaaccatcagcttcagctctcgtgagaactcactcactatcacgagaacagcaagggagaaatccacccccataatcctatcatctcccactaggcccctcctctgacatatggggattataatttgagatgagacttgggtggggacatagagcccatagagccagaccataccaaaggtagccaaaagggaacccactccatttctgaagagggcagaattcctctgaagaagttcctcttttatcttcttttttttttttttttttttttgagacagtctcgctctgtcatccaggctggagtgcagtggcatgatcttggttcactgcaacctctgtctcctgggtgcaagtaattctctacctcagcctcccgtgtagctgggattacaggcacctgccgccatgccccaccaatttttgtatttttagtagagacagggtttcaccatcttggccaggctagtcttgaactcctgatcttgtgatccacctgccttggcctcccaaagtgctgggattacaggcatgagccactgcgtccggccccccttttatcttataaatgtaaataaattttgtgttctactctgtaaatatttatgattattttagtatgatattaaatactgactgaagtacatctatcactcagagtcaggtcaagaaacagaaaccatgcccattattttaacagaaaatttaatagaaaaagttgataaccacgtattggtgacctaaaaaaaatgtagaaagagggtactgaggtagcaatgcagaaaacaaaacaactaacacactagggctggggaacaaagggaagatttaaggattattaagccctggaagaagaaaggaggggcccctgagggcttggccatgtctctgaggaggggacatgaatgactggtgtgggtgtttctgtggggatcaatgaggctggttctgagcatgtgggaaaaactgcaatgtggaagcaaccgctgctactgaaacatctgttttttccagcgaggtaaacaattgtcactgggctttggggtcagtcagtaacaggaaacagaccagaagaaagagatcccttcctcctttttcctccaacttgctggcactatctagctccccctcttggcagaaccgaaaagggagcagctggtaaaacagaagtgtatttccagagtgtcagccacagtctcacaaagctaaaacacaataaagcaaggttgaagctgagaggcaataacttaatcatcagcccagtactcagttgttttccaataatagttctagttgaattgatgcaccatatttattcagcctatgccttcatatgcctctgccaaacattttacagacttgacaatgcactggctttgtctattaccagcctagcatgaattagcttagaaggcgtttagcaagggccaaggacaccagtattcccattccagttcagccacttttttatgacctgggacacaccactttctcagttacctcttattgaacacgagggagttgcatcaaattctcttcaagtctgttccaactttgtaattactggagattattatgggaaagctcaccttttataagcatggcttttgtggaaagggaagtccaaaacactgagatttctaagactttgttgcgcatccagacatagctaaagggtagggactgggaggaaaagagccttagaaaggagatgtgggagaaggaaacaaaagcgggattagaaaggtgctgaaaagaaacccacaggggtgttaaggggagagcaggtatgcagagcagaggagagcacctggcatttctgggatttggattacctgaattttgcttgatagttcatcttatgatttctggtggttgtgaaatgtaagctttgtgtgctctgtaattctgtgcagcaacaagatagaatggcacaggtctactcaggtgacagccaacctttcttttgtagtaaggaattagagtcccagtgttgaacacctaatcctctcttcccttgagggctgtaaaaatggagagagagacctgcacatcttgccatctgccacaaggcatttcttaatccaactcccttcatctagatgaaatactttgtgcttggcagaatggtgttatttcaatgtaatgtatgtgtaacctactcccttgccaaggaaagattgcttctaactagatcacagaaaagacaggtgtgaaccaaatgatagacaacatttcgccagactttgtgtgtttggtgttaatgcctgaatgctaacaattccccctagaactctcccttgaacttggttacaaaacactctgtaattaaatatcccctttaagatatcatggctaatttaatgagggccaaccccactataacagattgttaatctgagctggtagagtttttttctctttgttgcatcttcaagaatttttattactgtaagatagttggtaatattctttattaggctgatacgttttgaattgcttttcattttattatcacattagttccttcttaatggttttactaggactcagaagtctctggagttttaataacctctctttttttctgtacttatagtcatggaattaattttataaaatcacgatccttcactgaatatgtcattgggccaaaagaataaaattcaataagaagaattagaccttgaagagtgactgacgattcatcatgctactgatttttcactttgagactttcatttgctttgcagcagcacaatttctgttctttccacctctaagaatatactttaggctgaggaatactttggaattctttgaactgaggattattaaacttttttatataagctgaattttttaaatataggaaagtacatattcttactcatctaagaaaatacaactcttttgtagctggctttgtttaaagaacagataacaataaggtgaatttttaaaatcatcaaattatcaatcaaccagttttcttaggatcttattttcatgtttatcttccttgatccatagtggtagcaattctctcaaaaataaatatctactaattaaagtcctgagatcaaaactcctttattaaatataatttaattggtgtgaattaatattaaaagaacaaaatgtcacctataacatagtctgaaagaacaaaaattgtaaatcactttttaacttagccattgccaagcaatgagactatcaagtggaaatcagtagtcaaattttcaaagaggaataaataattaagtgcctgataacaatattaagaattgggtgaattaaaatcatagttacaaaagattcattatcaaacgaaggattatttcaggtgataagaaacttcttttacaggtatataactgaatacatacattgctgctacagtctctctggcaccagcaaattagaatattattacccttatgtcacaatttctcctctaaatctaacacataatggatgtgcaataaatgtctactgaatgaatggttttgtgcagttaatgggtttaatcagttaaaagagaactgagcttttcaaacataactccttggtcagacaaagccgcaaattttgcagcttgtcaattattgatggatttgatcttttaacaattcatttgggaagctgaattatctctaaagatatttaaataagtaaactattaaggtgataaccaaactaagacacaaactattaatatgttggttcttgacacatataaaactaaacacagattttaatttcttcaaaagcatcaggtatccaaatagcttcactggtaaaaatctaccaaatgtttaaagaagaattaacatcaatccttcacaaactttaaaataaacttcaaaaaaattggaaaggagggaacacttctgaactcataagcccagtattactgtgattccaaaaacaggtaaaaaagtcataggaaaagaaaactactgaccaatatcctttatgagtctacgcataaaaatcctcaacaaaatacaagaaaactgagtccaggaacatataaaaaaaatatttaccataaccaaatgggctttatcttaggagtatgagttgattcaatatataaaaaacaatcaatgtattaaaaatacactgtactacttaagagaagaaaaaaacaccatatgatcttctaacagaaacggaaaaagtatttgacaaaatttaacacccttttacaataacgatgtcccataaatcaggaatagaagataacttcctcatccactcaccacttctattcaacattgtataggaaattctagccaaggcaattagacaagaaaaagaaaaaaagactccagattagatgacataacgttatgtataggaaatcctgagagatccacaaataaactattagatctaatagatgtgtttagaaaggttacaggacaaggcatggtgccctatgcctataatcccaacactttgagaggttgaggtgagaggatcactcaagcccaggagtttgagaccagcctgagcaacatggtaagaccctatctctataaaaaataaaataaaataactagtcacacaaggtggcacacgcctatggtcccagctactcaagaggctgatgcagaattgcttgagccaggaggtcaaggttccaatgagctatgactacaccactgcacccaagctagggtgacagagcaagaccctgtctcaaaaagaaaaaagaaaggttacaggatgcaagatcaatatgcaaattgcatctctatacaccagcaatgaacgatctggaaaagcaatttggaaaataatttacaatagtatatatttaggaataaacttaacaaaagaagtggaagatttgtatgggaagcctacaaaacattgttgaaagaaattaaagacctaagtaaagggaacaacatccaatttttgtgaagcataagacttaatactatgaaaatctggttatgttttaaaaagtgtatagaaggttatagcagttaagcaaagatgaaaatgaaaactctaaaaatcatactttgattaaagtcacatctattttacttagggaaataatttttatcatcacttttctttatcatagagtgttaacacaaaaatgtatcacatcaaagctacatttctgtagggcaatggctaataaaatgaccccaaatatcactctatcttcctcttttgttaggataattataataaaatattctgcaattttttttcattagcagctaaatcacaagtattcttttgttattattattattattattattatttagagacaaggtctcactctgtcacccaggctggaatacagtggtgtgatcacgggtcactgcaacctcaaactcctgagctcaagcaatcctcccatctgagcctctcaagtagctggaactacaggcatacaccaccatgcccaggtagattttttttagcaataggatcccactatgctctccagactgatcttgaactcctggcctcaagcgatcctcgtgcctcaccctcccaagtaggcgtttattcattaattttgcgccactgactcccttttctcagcaagttttaccattttacaaaatattaatatttgatcagtgatgtttaaataaagcgccagccacagtaatgacactattttcagagacggagttcttttcttcagtttctgcaccttgcatctattgactgactcactgaaaattttacacattttacaaattttaccatttacacatactgtctgtgtatgtatgtgcctaattttgtaaaaacaattacaatcaggtcaaggaaataactgtaatctaatgttcattaaagtgaagatcgatctcaaaatataattataaaagtacagcttaattctctcataacctcagatgtacaaattgactacaaatctaaagaccaatcttttattcttccccaaaggcagtgaaaaagactaaagaggctcctgaaggtttaaaacactggaggataaaatttccattatgtttaatatcattctagcagtgatactctggatctgtgatagattttagagggcactgaacgtattggatttgaattataatgatcaaatctatcaatcattatcataatagatttcttaattaaaacacattataactataatggttataatacctttcttataagaagcctgcttttcagacttccatcactaatccatgtaaaaggagggaggcaacagatactattaataatatctccatttcatattttaaatagacagaaatgaaatgcttagcacaatgtcacctgacatcacaaacatttttaacactaggccaaaggagagagaaaacaagcataacaaactaagcatttggcacctgtcatttagggactaaaaatttctactctaggtcaaagattttacaggttgaatgtgaacataacagtactaaagttcatacaagtatctctgaactggaatgacatttagatgttactaatacaaatgggataaaaacactgaaaatgccctctttgaaacaatagcaatgaaaaatacagcagttcctacaaagtttaagaaagttgttcataagggccaggcacagtggctcaagcatgtaatcccagcactttgggaggctgagggagttcgagaccagcctgaccaacatggagaaaccccgtctctactaaaaatacaaaattagccaggcatggtggcgcatgcttgtaattccagctactggagaggctgaggcaggagaatcgcgtgaacccaggaggcagaggttgcggtgagccaagatcccgccattgcactccagcttgggcaacaagagcaaaactccgtctcaaaaaaaaaaaaaaaagaaagaaaaagaaagttgttcataaagacttgaagttggcaacaggagaattttttgaaaataaaggagataaagaaaaaaatatttagagctagcacatacctacatattttctcaccatcccactatctagcatacagtcagagagcttttttctgcaaatggaaaatttcacatgaatataggcaaattggaaacctaattcagtgatgacactattttcacactttttaaatttcttatggtattgataaaagatatatatttgtctggtagttgcctttatatatttatagtgcctttacacacctttcttcttaccattttactatctgcttttcagtcttcactggaatcctttgactgccacatattagctgtataataagcaatggtcttttaccattttcccctttctctcttttttcctatatcatggtgacatttttttcaactttgtcagaacctatgacttttgcatattttttctactcacatttccactctagttttaatcttaattctacaataaaatatattaaattggcatcattagtccttttgctaaaatttccctagttgtttgtaagtttgatgaagctcctcttctggtagacacgtcagaaaaggttcctgagtacagtattccctgagttcctgtacatgtagaactatttttatacagctttgattcttaatgaacagctcaactgaatgtagaattcttggcttgcactttctttccttgagtttcttaaaaatgttgcttcactgttactttgtttgtacactgctattgagaaagctaatgccagcctaatttccttacccttctaagtaatattgtctttttgcatggaggccctggggaattttttctttgtctttaaaatctaaaaattttactacactattatagcctagagttgattattccattccattgttccaggcatatcatgggccatttcaatatttagattaaggttttctcttatttccagaaagttttcttgaaatatagttttaagtattagacctgtttcattgttttatttttcttcttcttcaaatatgctttcatttattcttctttcttgaaatatagttttaatattagttccggtccatgggtggtagtaaatcttcttctctttctcctcctttgcttcctcctcctccttcttcctcagtatcatcttcttcatcttcattgtcttcttcttctccttccctccctcttcctcttcttcagttttacaaatgttagatttgctttgcctctcttccaattcattcactttctatctgacgctttttactcctgtctttatctcattatattcttggttgtttgcctacctgttatattcttggttgtttgcctacctttatttaatggtcttattaaaatttccaggtacaaatagcttcactaataaattttaccactgcttaaagaaggaataatagcatttgtgtgtctaattctacataaactctatcagaaaagagaaaataaggaaacactcctgaactaaaatggccagcattgccctgataccaaaacctaaaaaagacctttgcaagaaaagaaaactaaagatcactattctttatgaatataggatacaaaatttatcaccaaaatattagaaaatgaaatcaagtaatcataagaaagattattcattatatccaagtgcaatttatcttcgcaatacatggctagttcaacattcaaaagtctattaatgtcattcatcatgtcagcagactaaaaaagaaaacatgcaatcatcttgacagaaacagaaaaagcattttgaggaatgcttttaatcaaatgattgacatcaattcattatttgtaaaacctcagcaaactaggaatataatagaactttgtcaagctgataaagatcatgctcaaaaaaactacagctaaagttaacataaagcttcatggtgaaagattgaatactttcttcctaatacacgataaaaggcatggatgtcttctttccccgctcttatacaacatcaaagtgaagatcttcaccacggcaataaggcaaaaaaaaaaaaaaaaaaaaaaaaaaagaaggcgtacagattagagaggaagaaataaaactgtcccaatttgtaaacaaaattgtgtatattaaaaatcacaaagacagcttggccaacatggcgaaaccccatctctaccaaaaaatacaaaaattagctgggcatggtggcacatgcctgtagtcccagatactcgggaggctgaggtgggagaatcgcttgaacccagggacagaggttccagtgaactgagaccacaccactgtactccagcctgggtgacagagtgagaccttgtctcaaaaaaaaaaaaaaaaatcataaagaatctacaaaggaactactagtaagcttagcaaagtcatgctcaatatataaaaatatataaatatataagtatataaaaatcagttgtaattctatgtacaaggaataaaacaattctaattacaaactgaagttttttaaataccatttacaatagtacccaaaacataaaatacttaggtataaatccaaaaaaagtgcaagatttatatactgaaaactataaaacactgatgaaaaattttaaagacctaaataaatgtgagatagaccacgttcatagattagaagactcaatattgttcagatagcaattctcccggtttaatagatttaatgtaaaccctttcaaagtcccaaatactttctggtagaagttgataagaaatgccaatgaaaagacaaagcaatttcaatatcgaaaacaatgtttaaaaggaacaaagttggagatgcaccatccaatttcaaaatgtactataaagctgcaatacttaagactgtatagtattaaataaaggatagacacataaatcagtggtacaaaatatacagttccgaagtagactcacatttactttggccaattaattttcaacacagatgcaatggcaattcaacggagaaagaatagtcttttgaacaaatagtactgtaccaattgggtagccatatgcaaagaaataaaccttaatccatatcttatcccataaaaactaacccagaatgaatcataggcctaaaccgtaaaacctaaaactataaaacttctaaaattacacatagaagaaaatctttgtgactgtagcaaagatttcttagatacgacaccaaaacacaattcataaaagaaaagactgattaaatttgacttcatcaaaattaaagacttctgctttgcaaaagacactattaagtgaatgaaaagaaaaactaggctgggcacagtggctcatacctgtaatcccaacactttgggaggccgagacaggagggttgcttgaagctaggagttcaacaccagcctaagcaacaaagcatgaccctggtctctattttaaaaagagaaaggaagaagggaaacaaaaaaaaaaagaaagaaaagcccacaaactgggagaaaatattggcaaaacacattgagccaagcgtggtggctcacatctgtaatcccagcactttgggagactgacgcgggcagatcacctaaggtcagaagtttgagaccagcctggccaacatggtgaaaccccatctctacttaaaaaaaatttatatatacaaaaattatctgggcatggtggcacacacctgtagtcccagctactcgggaggctgaggcaggagaattgcttgaacctggggggtggaggttgcagtgagccaagactgggccactgcactccagcctgggtgacagagtgagactccatctcaaaaaaaaaaagtctgataaaggatttgtatcctaaatatataaggaattatcaaaactcaatagtaagtaaacgaacaacccaatttttaaaatagtcaaaagatctgaacagacacttcaccaaggaagatccataggtagcaagcaagcatatgaaaagatgctccacagagtatgtcattaggaaaatgaaaaatgagaccctaataagaaaccagtacatcaggacagaagggagaaaactaagaaaaccaagtgctgatgaggaagcacagcaactggagctgtcgtacactgcaggtgagattgccaaatggaacagcacactcaggcagcttggtgggccaggcccaggggcccctgctctgtgcagcctggggtggaattgtatggtttggctgtatcttcacccaaaatctcatcttgaaatgtaatccccataatccccacatgtcaaaggtgggaccaggcggaggtaattggatcatggaggcagtttcccctatgctgttcttgtgatcatgagtgagtctcacgagatctgatggtcttataagcgtctggtatttcccctgcttgtactctctctcttctgccctgtgaagaaggtgcctgcttctattttgctttctgcatgattgtaagtttcctgaggctgccccagtaacgcaaaactgtgagtcaattaaacctctttactttataaattacccagtcttgggtattcttcatagcagtgagagtgcagactaatacaggtagcaggcaagcatatgaaaagatgctccacatagtatgtcattagaaaaacacaaaatgaaaccctaataagaaaccagtacattaggatagaaggaagaaaactaagaaaaccaagcgctgatgagaatgcagagcaactggactgtcacacactgttggtgagaatgccaaagggtacagcacactcaggcagcttctcataacattcacatacaaccccacttacttacccaacgtcaacaaaaactcacgttcataacagaaaacctgtacgcaaatgtttatagtgaccttatccataatcatcaaaatggggaaaatccaaatgtttccctactggtgaatggataaacagacaggtacatccatacaatggaccgctactcattgatgaaaagtaattaacatgcaacaatatggatgaaactcaaatgcattataccaagggaaagaagctggactcaaagggcaatcacattctgtgtgattccacttatgcggccttatagaaaaggctaaactaattgcactccagcctgggcaacagagtgagactctgtctcaaaaaaaaaaaaaaaagaaagaaataaaaggctaaactatagggacagaaaacagatcagtggttaccaggaagtaggagttagagacgagctgacttagggggcacaatggaattttgtggataatggaatttgtctacctcttgattgtggtgatagttatgtgactgtatgaattgttagaactcacagcactgtaaaccaaaaaaggtgaatttgtctctatgtaaatcatacctcagtttttttaagtatatgactttcatattcttctgttaacacctggaaacattaaactaaaacattcctacatagcacttacataacttatcattatcaacctacactcagaagatatttctattttctcaggacagaatattggtttttctgaacaaacgattgaaaactgaaagcaaatactatcaagcccactttgaaactttctcctgctgtggggaaaaattgcctataaattgcaaatcactgtccttcatcattccccttcacacacaaattgagcagtaaaatcctctttcttgttttaatttcagcaatagttcatttgcttctgggaaagaattcatcataatcaatctgattattttcatgtttgctagcagtttgcatgatttgaccaatagtcatatggataatttgaaatatgtttgttcatatcagtctaacaataatccattatgttctgtagcaaagtaattctttatgcctgaaaaaaaaaaatcagaatcatctgttttaatgcaaactcacctgacacaggataaaattcgtcttaaatggcactgagtaaaaccaacctgaagaaataatcaccaaatgactgaagacacaaaacacctactcgtgagccaaaccatgaagcagaataaaatgtaaatcacgtacttatctcatctcagagaacagctgagcactcaagcttttcttcttctttttgcctaagtgagtggaaatgttttcctttcatttactggaaacaaaagtgatgccacatcagcagataggctacgaaataaaacattaaaaaaaaaaagatgatgcctagttaatggaaacaaggcacacgacaggagactccattagggcatgaattttgcaataaaaaactgtattgggagccgggctcagtggctctcacctgtaatcccagcacttggggaggccgaggcgggcagatcgcctgggatcaggagttcaagaccaacccaaccaacatggtgaaaccccgtctctactaaaaatacaaaaatttgccgggcatgttggcaagtgactgtagtcccagctactagagaagctgaggtaggcggatcgcttgaatctaggaagtggaggtttcagtgagccgagatcgcaccactgcactccagcttgagtgacagagtgagaccctgcctcaaaaaaaaaaaacaattgtattggggaaaatgtacatgtggaaagaaaaggcctatgatcctatcaaggacagaaagagcacacagcacatgccaggacccacggggtccaagatgcaatatagataggacagccaaaaatacaccaagttagcggtggagggagcatgagagaagtcagctcagccaaccagtgaacaggaagaaaaccattaagtggaaaagaattcataaattgtaaataaaatcagaaacatgatcaatgtgaaataaagaattctatttttggaacacaccctccccaaaagacatgttttgacacatcataaatgaaaaatgttagtagagtgaaatgttctctcaattagtcattatgctaagagaaaatttgttattaaaaattccattttggactaattggactttaggaaggtccttatagacaaaagagagaaacagaagctagaagagagcatcactgagtagattattagctaaataaacaatcaaccaggtgcggtggtcccagcactttgggtgcccaaggcaggtggatcgcttgagcccaggagtttgagaccacccatgggcaatatggaaaaaccctgtctctacaaaaaaaaaaaaaaaaaaaaagcaaaacttagccgggtgtggtggcgtatgcctatatagtcccacctactcaggaggctgaggtgagaggatcaattgagcccaggaggtagaggctgcagggagccatgaacacaccactgcactccagcttgggcaacagagggagagctgtctcaaaaaaataaataagtatataaataaaaaatctcctaagagtgcttaacaacagcacaaatctgatacaatttgtcggctagggaggtctcaggtgtctgatcacagccctgtctcaaagtttgtgtctgttcctctcaaacaacatagacaagaacactgatcacatggttattaaagtcgcatgtggcataaagtactcagagataaccaaatgattgattaaatttacaccccaaaagccctaaataacccatagcaatggggcaaatctaacacgatgaaatttaaaaaggaatatatttcaggttcctcacttgcttcaaaaacataaaacccacttgggtcaaaaataactccacttaacgtggtttatataagatatattatgtggcatatgtggcttatcagaagcacaaacagaaattccacagaagttgagagtgtgatgtcccagcctcattcaagagcaaggaaaggggtggtctgttctcctctgcactaggtgggccacaccagcggctgtgtctggctctaggagccacattccagaaagacgatttacaacctagcttctgttaaggacagttaccagcctaggggaccattgggttatgtaaagaactgtaagaacagaagactggggacacgagagaccttctggcattccaagttctagcccatagtaaagtgttagatttgctcagcgtggtccccagagggtgaaattagggccagtgggtggcaaatgctagacagccaggttttagccaggtataggaagacacttccaagctaggtgtggtccctgtaatcccagcactttgggaggccgaggtggaaggatcacgtgagcccaggagttcaaggccagcttaggcaacatagtgaaaccccatctctataaaaacttttttttttaaattaaccagatatggtggtgcgttcctgtagttcccagctactcaggaggctgaggcaggaggatctcttgagcccaggaggtcaaggctgcagtgattgcaccaatgctctccagcctgggcaacagagcaagaccctttctccaaaaaaataaaaaagaaaagagaaaagaggacgacatttctgacaggggtgcctcaaggtaaaacaggctgccgtaagaattgggagcaaattgccagtttctggacacatttctgcagaggctccaaaaccacaaaagaaatattttagatgagggctgatggtcatttggggttaggaacctaaaggttcctctaggtgctgtttgtgtgtgtcatttgctcttcacccaatatgtccactttcagacaatacaaaaagcaaaagagaacgtgtcttggcttttatcttgctgtcaaaatctggtgcggggcataaccagttctaaaaggtagcattaaactttcagagaaggcaagaaaggacaatgggggctaggggacagggagggccactggagaccagacatcacccaccatggccaggggatgggaaggacccaccgagaaggggggttctgcccaaggctgctccctcactcctccacgctgagtctgaggcctttccctgcccacccgctgtctgcctcttgctaacttttttggttctttaagctgctggcctaaatctcacaaatagtgtgtttctgtctttttattttattataaaaacataacagaaaaaaaagggaaaagactagtttaaaaaaaatcaaatcatgaactatttgcccagtgcaagtcatctgaaatgcccttctccatcttcgggaaagcttcgctctgaatgctagtggatttgccctgaactacccaagctctgatttccggagcattatttactactgtacatggtcgcgacagttcagtctatttcagtcccacagcaacactgagtatttctctcttccatacttgctttaaaaagttgcaactcacatgtgaatcaaagctaatcttctatgtaaatgtgcaagccttcaaaactttttattgaaaagtcataaacacagtaaaaaatgcagaaaatattttaaaatatataatgaagaagaagtcttcctctcaggtcccaatccccatccaccttccccaaaggcacaagtgatgaccaatttcttgtattaatctatgcatagattatttctttatttatttttgtttgttttttttgagatggagttttgctctttcacccaggctggagtgcagtggcatgatcttggctcactgcaacctctgccccccgggttcaagcaattctcctccctcagcctcctgagtatctgggattacaggcgcttgccaccacacctggctaatttttgtatttttagtagagatggggtttcaccatgttggccgggctggtcttgaactcctgacctcaggagatccgcccacctcagcctcccaaagtgctaggattacaggcgtgagccaccgcgcccagcctgcacagattatttctaacatgatatgcaagtgcatgtgtatgctcacacacacacatatatgtgtgcatgcatcaacacgtgaacactctttttcacataaatagaagcaactctcacaatgttctgcccttgtttttgcactcaaggtgtgctacacttgtcactataacaccaattaactcacacaccactggcatgcagaggaatgatgtcagagtaacctgcaagttgcgttggttcacaggcaattttttctaggcaaggggagcttagctttgaattacgagtgtagaataagaaccttcagcaagaaaggaaatggctctccatatgaagatctttcagtagtgtcttaagaaaatgtaaaaggagtgcctgcacggccccagagaggggcaccccaccttgccagttcctaccttgtcggtcctgggcttgcaataaggtgtaaatccttcagtgctcatgtgcctgtcatccccaaagcagcatccccacgccattattactattaatagtatcatcatcccctcaagcagtttcagctccactgagctacctgcccggactgcccaagttacctccctgtgtaccaggattgcttctgtcagtgttcaggtttggaagttgcacatgtctcaagaggggtcccaataacgctgccttttctgtagagctggttatgtttaatgtgtgccgggcagagtgcatgtgatagcagagaaggctgtatcttgggaatcccatgtgaactggtgcaggtcactggacagtcttcctcacagctgctccatacactagctgtgtacttcactagtctccaaccaatgcccgtctaggctgcatgcagtgacttactaattaaatgatgctgtaattaacctggaaagacatggttatgaactgaattgtgttcccctccagaattcatatgctgaagtcttaactcccaggacctcagatcgtggctgtatttggagacaaagtctttaaagaggtaactacggggccgggcacagtggctcacgcctgtaatcccagcactttgggaggccaaagcgggtggatcatctgaggtcaggagttccagaccagcctggccaacatggtgaaaccctgtctctactaaaaatacaaaaaacttagccaggcacggtggcaggtacctgtaatcccagctactcgggaggctgaggcacgagaattgcttgaacctgggaggtggaggttatagtgagccgacattgtgccactgcactccagcctgggtgacagactgagactctgtcccacaaaaaataaaaataaaataataaagatataattaatataatatattaaatataataaaataaaaatagcaatatgtaatctaacacttaaatcaaagatcagtgggcatgtgggaaaaaaaaaaaagccatgggataaaatcacaaagattaagtgcctgggatgaggcataggaaagcagaaagggaaaatcccctgcaaggtggcagctttacctgcctcacgatcctgctaactgctagctgtgctttacctggatttagcctaatgcatcacgtcaccccgtcgctcctttaactctcacagtccatgcgagaaacactacaaagccacttcacagcaaaccctaccttaccgtgcactttcatgtaccacccagtgtgggatgcacatgcattttgtgaaattattctgacatttggattcttttaaaaaataattgtgcggcccactttttcatcccacgatattagagaagaaagctaacttgattccttctttccagctttgaattaaacctagtgatcaatgaattattgttttatcaatctttcctggataatgttcacaccataatattaaattagaaaaagacatctaatttccctcacctataaaagttatatgatctttctgctcatgttcaatttgcatcagtccattgagtcacaagtgttccaactccaacacaatcgtgacgtgtcgttattacagaagcagctcattctgaaggaacaaggtgttctgcctaagaggagtcccagataactcaagtttgctattggagcacaggaacttgattgtgttatttaaatgcagctatccttacatttatatcaatgtacatttttctatttaaacatatagcccgcattgtctttgggagataataagttccttgtgtttaataattgccatggcaagtggtatttccattcatcataaaatcacttatttcatagtggagttcttccaggaacatgacactcgatgtaatcagatgaggagacaagccgagacgttctgaggttcagtggcagctctgctcctgctgaactcagggccaaggccccactggccaggggatggagtgagcccctggcttagtcttatgcctcaggacggtggcctgctccctggactcagagaaaagcctgactgttattctcccatctctctcacagccattgccattcctctggcctcaatctcatgaccttaattctatgtgttcaatctttctgttccctaaattctcaacatggaagctgacatctcatctcttcctgccagccactttgctggccagcctacagcctggcctgctttggctcagaggcccaacactgatcccatcagttggggaagggctggaaaggggcaaggtttggtcctcataaggctgctcccttggcaatgaagcagtgtcacttaaaagaggataagacaccactagtgacatattcccaccaggggcttcaagaacagtccctcagttctaattggcatggagtaagcatcactgtgttagctccagctaaaccctctgggatctgacagacgccaactttctcttctgagcatccacacttcctggctggattctgatacagtttaccttcatccatcacctttgccaatattttggctactttgttaggcaataccagagtgaaaaattgccacagcgccctaatgtctggggggatgctaggtttagatggagttacgtgacacacttttattgccaaaggctgctttagtgcctcacagatcttccgcggaggtctgccgaaaggattcaggtggccctgctcagactggaaaactcctcatcgttcagggtaattttaggactccatgcctgcctgtggatggatcccttctacaacatccccaccaagtggctgtccagcctccgctctgcatctccaggcagaaggaactacacccacaggcaacgcattctaacttttaatgactttgttaagacggtactttgtactgagcttaaatttcatatcccttcaacatccacccaatgaccctactttgccccccaaagccaatcagaacaggtttacttccaggggagcaactgagtgtaataaagacctggtgctcctgtgtctggctgtgattctgagcaagttaactacccttgatttaaaaaaaaaaaggaagacagggctatgtccctgcggaggagaagggtatacagtgcatggaaacccctggcacacagtcgtgtccactaccttcctttcatctgcatggcagccctgcagatatgtgaaaatatctgcctccaaacatcctctcgtccagagtaaacattcacagcctctttaattgtgccgcctaggatatgttttcaaggcattgaccatccggaatgtatttctgttgatcagtgtggcttctgttccttttttctatttctagttttttatgtcatccattctaaaccattattagtttatggacaggccataccaaaggcatcccccattgtgaaccaggaaggggaggctcagaggagaccccacccaagaagacccccccatggagggatggtgccaagtctacccccagttgccacccacagggacagtggaacttctggagcctgtttagccaaccagctggactgtcatgctagaggtatggttggcctcttcccggccatcccactggagaatcctttggaagtatggctccctccacttcccatcctaatgagggctaaggagatgttgactagagctgggagaagtgtggatagtgccagtgctcaggactgggcgtggctcttctaagttaccagctcctatacttggtaaccctatctgccaagaatggcagtctgaaagtgaccttggtttccctaattccttttctaatcctgagaaatagtctcctcgcctataaagctccctgtggtatgaggacatggctgaggctatgctgtggcttgcccatacccctaagaacaggaagacctcctggggtgactggtgttcctcaggagccatctgatcacctgggaagtctggtccaaatgcacggccctcttgacttggtagagttcccccagacaccactcctaggaactactctgtgagtggggctccctcccccgggaagtctccatccttcacatgctccagacgcaccttccagtcctctagtcctctctgggtggagacagtggcctctccatgcctgcactgcacactgtcggctccccttgccccaggtcagccttacaatcctccttcctccttcaggatgatgtagggtgcaaataacacaacattcatgtaaaagcagcataaaacatgggcttattacttcacataacaagacgtcttgcagtacgaggctcagggtcaatgcagcagctcagcagcatacccaagacccagggtcgttccgtctgtctgctccaccagcctcggtatcttggcttccatcttcacttttccccgcatggttacagagtggctgctaaagctccaggcattaccgtcctacatagcatgtccaaaaacaggaaggatgcttgctcctcatgtaacaccttctattagcaacaaaagcctttcccaaagctccgagcagacttcccctcaaatctcattggcaggaaccaggtcacatgcccacagcccaccctaacacccatggcaaaggggaatggaattgggtaattgatagggcctctcttcactgagcacattgatcctgacacctgagaaacggagggctctgctggcaagacaaagaggcgggggtaggaggcaggcagtgtctgcacactgccttcccagccccctagtgtccctgctccaggacaggcgagctgggtcagaggcctacagatgttactgcacagccaggtgagaacagctccatggtccagatgacttcaggcatcttaatgaaaggctggtcacactaaggcacatagggccccaagggtacttcttgttcttctgtttgttgacttaagcagactcctgaagtatgcactgcaatgactacagtttttcccagaatgtgctcagccagtgataagctatgaaataaatgcaacagcacaagctcagaagactcctggacttcagaacacttatttcttcacagccaggtctttaacacctttggccaccagagaaagtactttgggaggggaatggaatccagctgcatggcttaaatgtcaaaaatcttgcatttcttctattctgttgagctgtaatgtatgttgtgcataccatctcccagcaatgatgaacacagtgtatctggaagaaagtctcatttcttaactcttttgaacttgctctctcctgcacttaatggagctaagcatctgagggagtctgaacaccagaactaaccgagggtctgaggagccacctgagacacctggggaacacagggttgcattcctgggggtcatgcttttggaggaagatgcattcagatgggagattgcttaagtcatcagcccaagtgttcatggaaacccccatgtctgtttatcacaggtcctgttaggctacatcacccctaaactatacttcttttgttttcaatcttatcgagttagcattggcccctgatttcaatctgtacctgcatttataaatcctatttttgacagccaacacagtagctctcattccctgattcatgtcacgtacaaatttgatcgatgtccttaacctaataactgataaaaatttaaatcagagaagccacactaacctctgcaggaaaatccttactgtacagtttacttaacaagccacaatttcaaaaagcaattaaagatcctgcagactccaaatcacaacacttctatgaaacagcccgtttgaggttgagagacaagcatcatctaattcttgtgaaactaaatgctaagttattaataacttaattaaaaacaaaaatgctaagttattaataactctgcacatagcttgatgcctgtattagtctgttgccacgctgctgataaagatatacctgagactggccaatttacaaaataaaggggtttaactggacttacagttccacatggctggggaagcctcacaatcatagcggaaggcaaggaggggcaagtcacatcttacgtgcatggcggcaggcagaaagagcttgtgcaggaaactcccccataaaataaccatcagatctcgtgagacttactatcataagaacagcatgggaaagacctgcccccataattcaattacctcccactgggtccctcccacaacacatgggaattcaagatgagatttgggtggggacacagccaaaccatagcattccatccctggcccctcccaaatctcatgtcctcacatttcaaaaccaatcataccttcccaacagtcctccacagtcttatctcatttcagcattaactcaaaagtccacagtccaaagtctcatccaagacaaggcaatcccttccacctatgagcctgtaaaatcaaaagcaagttagttactttctagataaaatgggggtacaggcattggataaatacagccattccaaatgggagatatgggccaaaacaaaggggctacaggccccatgcaagtccaaaatccagcacagcggcaaatcttaaagctccaaaatgatctcctttgactccatgtctcacatcctggtcacactgatgcaaaaggtgggttcccatggtcttgggcagctccaccccggtggctttgcagggtatagcctccctcctggctgctttcattggctggtgttgagtgtctgtggcttttccaggtgcacagggcaagctgtcagtggatctaccattctggggtaggccctcttctcacagctccactaggtggtgccccagtaaggactctgtgtgggggctctaaccccacatttcccttccgcactgccctagcaggcctcactgcccatgagggccccgtccctgaagcaaacttttgcctgggcatccaggcatttccatacatcttctgaaatctaggcggaggttcccaaacctcaattcttgacttctgtgcacccagaggctcaacaccacacggaagctgccaaaacttggggcttccaccctctgaagcaatagcccgagctgtaccttggcccgttttagtcatgactggaatggctgggacacagggcaccaagcccctagactgcacacagcacagtgaccctggggatggaccacaaaaacattttctcacaggcctccaggcttgtgatgggaggggctgccatgaagactctgacatgccctggagacattttccccatcgtcttggggattgacattcagctccttgttacttatgcaaatttctgcattcagcttcaatttcccctcagaaaatatgtttttcttttctattacattgtcaggctgcgaactttccaaacttttatgctctgcttcccttataaaactgaatgcctttaacagcacccaagtcacctcttgaatgctttgctgcttagaaatttcttctgccagataccctcaatcatctctctcaagttcaaagtcccacaaatctctagggcagaggcaaaatgtcaccagtctctttgctaaaacataacaagagtcacctttgctccagttcccaacaagttcctcatctccatctgagaccacctcagcctggaccttattgtccatatcgctatcaggcttttggtcaaagccattcaacaagtctcaaggaagttccaaactttcccacattttcctgtcttcttctgagcccttcaaactgttccaacctctgcctgttatccagttccaaagttgcttccacattttcgggcatcttttcagcaacataccaatttactgtattagtctgttttcacgctgctgataaagacatacctgaggctgggcgatttacaaaagaaagagctttaattggacttacagttccatgtggctggaatatcttacgtgaatggtagtaggcaaaaagagcttgtgcaggaaaactcccccctaaaataaccatcagatctcattaaacttactcactatcatgagaacagcacaggaaagacctgcccccataattcaatcacctcccaccaggtccttcccacaacacgtgggaattcaagatgagatttgggtagggacacagccaaaccatatcaatgcctctataaacccaccaggaacacttctagaaaatgttgaacacctccgaggccccacagaaccctcctctacccacatcttcatggcaaggagctaccatggatccccctccgagtgtgcccagaccagttacaggactggttacagtggaaggcaactgagaggcatagagcaagagctgccctcccactaaagtcacacaccacagaaagaactcattcttcataagaagactggagctactgaaaaagggacagacactagctgccaaaaacctggctgaagtccacaacatcacatcccctcatctcagactcacacaggtgctctctacaccatcacactgtttacttcagagaactccacacacactaagattcccttgcttatttgtttgtctctcctttccagaataggaattccatgaggccaggggctttgcatgtctatttaccgcagaatctcagagcttcttctacagtagatactgaatacatatttgttgaatgaatgaatgtgtccccagatgtttctcatttaaatgaaaatgatcaaactgaccaatttttataagtttagttaaagatgtgaccatcttacttcattacatctccattaagacagtttggtatttcagttacaggtgtatgactgggagttcaattcttttctgtgataagtacgaatgactcaagctaccattcaatattcactttacagatatatgaagcttgtctactcacgttcaaaggttttccttaattcgtcttttatctaaatcagtcaagtctcttctcataaatgagaaatattaaatgagtggcagctctcaagaaataaaaaagtgactagcagaaataatctgcaacttctgtgaataagatttttctcagtgtctaaaataacaaacaccatttatggaccaaagactaggtgccatgagttttagaaattggtccccactccactgttatgtgtaccattatcccagtggcagagatacacagaaagccaaggctcagaggcagtaagtcatgggtccgaggcctcttgctgatgacaaaactggaatctgaacccacgtcaggcttacatttacacatacatgtatacaaatgtacacatatacagcttagattccataaaatacagtaatctagtggtggaacaaattatttctaataaatgttataaaatataaacgcctctctgaatcctttagaaaattaattttgccatgaagtacaaaaaggaaagagatacaacttaagtatgaacaaagttataggatactacaaacagttggtaatatatactgtctttaaaaatcatttctccttatcgaggcattaagccatattgtttataatgtgaagagctattggcatcttattttcctacccataaccatgaccatcacttattcatcttttcatgcatccaggtgcatggaaaggcagtaagtacaatttttaagaaaatagcatcaaaagcagattttaaatctacctgtttttcttcgtttgttttctccaacagttaaggaaagtaatagtaatttctcattccaaaccaaagacaattatgctcctttgctaaggacacagctgtaagtctctacaagatcagggaagactacaatatttcagaaaaacactcccagtcaagtttatgcttgaatgggcagctggaaatgcatcgatgtacagggcctcttttcacggcctctaaaagtgcttgcatcatatgcccacactgtgtctatcccctcccccgtgacgtggtctggagtccaatgtgggaaagggaaccggcaagcaataactcgtgcatcatcctcaagttcacgttcaagtttcttctccaactgcagcatctgtggagagtaacagctattattttagtgagcagtgagtcagaggaaatgatcccaaaatttcctgtttttaagagtccctgaaaatacctgagcaaaaattactacttgttaaaaagagcactctgggacacaaacacataaacaaacaatccattgaaatacagaagatacactgacagcagttgtaagaacaccttctagtattaattataaaatatgccatttttagcagatgtctatcatagatttatagttttctaaataaaatcaggatgtggcagtaattttaataagaagcagttttaaataacgcacttcaacacttcaatatacctagtctcatatatttaagacattatttttccaccattttttaagagagaggggtcttgttatgttgcccaggctggtctcaaactcctgggctcaagcaatctgcccacctcggcctcccaaagtgctgggatgacaggcgtgagccactgcgcccagccacatttttgcacatttttaacatctctgaaatcaggacacatcacacaacactaattgtcttagaattataattagcaatttttttgtttctcaatagcaatggtgcatcctaaaatcaagatctacagtcaatgaaatgtggtatagttagactatgaaaaaatatgcacaattctaccaactggaaatatcatgaaatatttcataatttttaaaaatgtatccataatatactgataatgaatttcttgatagcctaacttataccaccgttgtaccattttattatcaatctaccaataaagagtttttattatttgctagaagtattgatattttaattacatcagcaaattaacaactacttaaaaacttatctgcagatcctaaaaatatattaccaccttcaccaccttcacatcctaaaaataatttttttctactttcttcttttaacttgctattttgggataatttcaaacttccagaaaagttgcaataacagaacaaagaactcctgtatacctatacccaggttcaaataatttttttttttttgagacaagatttatcgcccaggctggactgcattggtgtgatcttggctcaatgcaacctccgcctcctagactcaaatcatcctcccacctcaacctcctaattttgtagagatggggttttaccatgttgcccgggctggtcctgaactcatgagctcaagccatctgcccacctcagcctctcaaagtgttgggactacaggcgtgagccactgcagctggcctacaggtttaccgattttcaacattttgtcacatttgttctcttcctctctttgaacatttttttcctaaaccattgcagaaaaggttgcatacaatatgctcctttacttccttaatacttcagtgtgtattttctaagaaaaatattttcatacataatcccagcacagttatattcaggaaatttaacattgtattccaatataataattccaaataacactgcgattctgtcattgccccaataatgttctgtataacatttcccaagggtatgatccagtccaggaccatttttgcatttagccataacattcctttggtctccttagacggaaaacagttgctcagtctttctttggttttcgtgacaataacattcttcagttatcggaccgagtggccctggcggtgggtcctctgatgtgtgctcatgagcagtgcggtgtgtggtctttggcaacaccccacctgtgaagctgtgaacttaccagggctccacagacacccaggaggcccttctgctcttgatgatggcagtaaccacacagtgaaggtgggatccggtgtctccattgtgcagttgctatttttgcttttataatgagtagtttgtggggagatgctttgggatgatgtaaatcctgttactcatcagagagtccctacacttgaaatagcactcacggatgattctggcctgaatcaatctgctaattctgtcctttcttctagatgtacagttggcactctaccgtaaggaacagctttcccctcacctgctctgcctctctctgtctccttatctaccgatctgctataaggacaaacacctatattcttatttcatttgatgggttataatccattactgtccttgtgtattcgaatgctcgaattctcctaatttggccactgggaggctcttgccgctggcttctctgtcctttggacatgctgttatcaaatactgtgagcactccttacattcaggcttaacaaaatgttcctggcttttgtatcttcccttccacagtcctgattcagcctttttctcaaagattcctggttcctcttagtgagaagtgatatttagaaaacaagatctaagcaaaaattattcctctaaaaagtaaccaagatgaaattgatagggcttctatgatggttttattcctggcctatatcttataaccaagtgctcagaaaaacttctacatgacctacagctggaatgaactaaattctaattcttcattagaatcaatgcgaagataacacagaataaattctattaaggatggaggaatttctattcttttaacagccagtatagattaaaaaaaaaaagttttgttccttgagggaaaaattaaataagcaaagaatgaaacaatatgtgtttttccaaaatatcagagatttcttatggtaattttgttcataaaaaggataattataaacttattcatgatgctattattcttttctcttttatagtttcttttatttccaaatgattgtcatatgctaagtcaagataaacctaaaaatgaaaggagctatttccatcataagaaattaactgactaaattacacataaatatgcaatgaatctggtgcttgatatcatacgcaaagagaagccgtgatgtgtcatgtctgcgtaaaggaattcaaaattattcatacaattataggtttcaaagtggcatgaactcatcctattctaattacatctacaaaactttaaacatagttctgaaaggtataagataacccagccctgccacacacacacatcccgccccccaggaaccccggtttcactgggccgccagtgtaactcactcctggcacttcctcctccccaggctcccctctcaagtcctactggttgcccctaatttcctagacctctaatgccagggtccagagctcatgccttcaacagctcatcctcgtgctccccatggagtctcagctactcccaggctccatctgtgcggatgcccaacaaacctacatctccagcccaccctctggcccgaaccccagactccttctcacccaccactgccagcctgatgtcatgtacacccaaacttcacatgcccatgctgactttcccagccagctccgcctgcaccttccccagcatagttcaaagcaactccaagcgtgtggcaggatggcccggtggtctaaggtgctagacacaagcttccacttcccaaggcaactccaaacttccagtaacttgggccaacacgctggggctgcctgtgaccccacctttgtctctctccccaacgttagatctgccagctagtcctgtggattttatcttcacaatgcacacagaatttgatgcttctcaccagctactccgtggcctggacacctgcaagagcttataacctgtctcccagcttgtacccacccctgcctccacatggcagcctgtgacccttctcaagcccagccagccctgcattcctctctgctcacccaaggctcctgcccttccaagggctggtgtccttcccatcctgcttcctctctgacctccccacgcacactcatgccacacctgcctgcttgctgcactgccccccaccctgcccgaggcgctcttccctgcacgccccctccctaacctcagaggtcacctttgcagggatcctgtccctgccccaccccgcccttgctttgctttgctccacagcacttttgcttctgctgtatgatgcatcttctacaggcatctcatgtaatatctgctctccccactagcatatgagcacctggggcaggtgtgttttctcttgtactcactgaagtattccaagcgattagaacagggcttgctatagtggccacacttgtcaaatgaatgaaggaaagaaggaagaaaaagtgattcagctacgagttatttttcttcactagaacataatgataatatttttgttcatcagttcataaaagccaagcatggtggctcacacctgtaatcccaacactttgggagtctgcagccggaggactgcttgagcccaggagtttgagaccagcctgggcaacatagtgagactctgtccctgcgaaaactaaaaccatcagccggacatggtggcacacgcctgtattcccagcgacttggcaggctgagacaggtgatcgcttgaacccaggaggctggggctgcagtgagccaagatcacgctctactgcactgcagtctgggcaacagagtgagactctgtctcaaaaaaaagaaaaaaaaaattcataacagaatttgtaactaaaattggtcattctttgaagttatgaaagtagatagctttctgggaaaagtataaataatgggtatatttagaccacattcattcattcaacaaccgtttactgagtgatgcctgtgccagtgctgcggtgctggaggcctgggccagctagaagaagaaaggcctggtccctgcccctgagctgatggtgcagtgcacacagctagcagtgtcgaagccttcagacaaagaaatgcacaataacccatctaaggacagggcaacaaggtactatatgagagtaaagcgggccgctggagctcgcctcattgtcatcaaggactgccttgcagaggaaaagacagctggcccatgagtggtcagtgctgttcgacgaagtccagagccagggagaccacagtcagaaggaaggaaacaccccaggctctgggaagagcagcaatggcgaggtccagggggccgagagaaggacggagggctggtgcagagagctgagggcagcatggcccaggggaggctggaggggagcaggggcccctgcgcaccagcctcagggccacagtgagtatttgggccttatccctaaaaacggcaagaagtcacagaagggttttacacaagagcaaggctgatctgctctgcactttgaaaagatgctctcagtgcgtaagctcatgttaaacatggatgttcacaaccccacaactggcttgaccagatccagatgggattcctgctcctttttagatagatacatacttgtgtggaaatgctagggcacctctgattttgagctacaaccgcacagagctgttagggatcatcagtctggtatcagaagcaggggtgagggtttacagccccagagattcctggctctgggcctccccaaggctcccctggctctctgagtatctacctgggcatcagcagggaacgtcacatggcatgctggctttgtggagtcacccagccacggctgggatggtcgactggcacagcacacgccccctcccctcatggcctccactgagacacagcttgatgaaggctgaaagtaggggcctccacacacaaaacttagccttccaaaccaacagaagccatcccagcctccgcacccctgaccgacccaccagcatgaagacagcaagctggccaaatctctattacagggaacgtggacactttgtatccttcagctgctcccctttctccttgggaatagtgaaatggtacatgttccttatttcagatttctctacatacagaagaatggacagtaatcacaaaagtattcataaataataagactcttatttcccctgattgaacagctccataaagtgagtcagtctacttcaaacatggtaagaagcacccggagtcggctccacaggtcctggagtgacgatgactaccaaaggccactgctgccccccgctgggacaagtaatcctgatttcatcatcctgcctctccacaacgcatggaatttccagtaaatgctaacattctatttttataaagcacagattcaaattaaagttacttgtctccaaaaagctaacaattccattttagaacgaaagcccaaacatcacaggtaataaatcaccatcaaaattgcgtatcaatctatgatcccaatcagttttttaaaaatgaccagggagtgtgcccttctacctcatttcacttctataagaaaaggctgaataccaaagtttggtcttaattttaggcctaatgagaattataaatgtacaggatactgtcactttcaagaacattttacaagactgggcacagtggctcacacctgtaatcctagcactttgggaggccgaagcaggcaaatcactggaggtcaggaattcaagaccagcctggccaacatggcaaaaccccacctctactaaaaatataaaaattagctgggcgtggtggcaggtgcctgtagtcccagctactcaggaggctgatgcaggagaattgcttgaaccagggaggtagaagttgcagtgagccgagatcatgccactgcactccagcctgggcaacagaacaagaccctggctcaaaaaaaaaagaatattttacaaaagcatttctaaattatattttaaaagtaaagaatatggcattatactgaaggtcttagtagtagaaatacatttctcaagcactgaaatgtcttatacaaaaatttgggtattaattaaaaaacaaaataaaaaaaggtaaattgtctttttaaaaaattaaaaccctatcagctatatcacagcattttagcaaacattcaattctgccaattttattatggctacaatgatagactttgaaacgtgaaaagggatttctttccatggtctgtgcaccagcaatacagcaaaagcttcccaccatgaccatccttccaaaggctaaggagggccattttcagtacaatactgtggcattttcacttttgaaagtacataatcaaagttcaatatgccatcctctagcaaatcagtaaactgaggtaaactgaaactactcaatgctcatccacccagaaaattatcttccttccaaatgggaggaatgatcaattcagagggaacatctcattaactttccggagcgatttcagcgaagtggaagtgagcggctgtgaaaactgcaaactacattagacacgggacctcagaaagcagtttccaaactggaatgtttaaggcttagggaaatcattgagaatttaatctgaagccaaagtttaaaagtatgactgaatcttttatgattaaacttctaagactctgaagtattttattaaatcaatgaactgaaatccagtgttccctaaaatctctgggaggccatcaccctcacacgggtgagtggtggtgttgtggctggaagggccttcaacatcatctaaccccaaacagagagcaggaaagtgcatactcaccatctgaggcacaccgaaaataacaacgttcgagtactgcgaaaaagtaacctgaacaaggtgggaaaataatcagtagattaagtgcaaaaagccaaacgtgaagcttaacttgttttacagaaatgggtagcagttttccattttaccaaacggtgggttttgatgaactcctaagaacagcggccctccttaagatttcacaaggaaaagaataacatgttcatgctctcattcattttaattcaatccactgcagttttccaaacgcttccctgtaagtcatcccatctcatcctcagggtgactccatccagggcacgccccagtggtcatgcgtcagacagctagtgaccacactgtgaccccactgtgaccagctggtggcaccggggccacgtgttcccgcaccagtccactctataccaccagcttcaccagaacacaggagacttcagaaccatctgttttttgttgttgttgaaccatccttaaaatttgagtccccctcctcttctctaaaatactatgtaaaaaagtgcaataaaatggtctttagttgaaaaactggggggaaatgtgctttgccagttaaaattcttattgcccaataagtcttatttactctatagagagatcgtttatgcacatatggcataaaaaaacaatgcaagcaaaactcaagtgaatttttgtaagctactgatgacaatattacaatggaaaattcttatttaagaaaaagcattttatggaacattcctaaagcaaaattacagggcatttttagagtttttagagtacaaataaatttggaagtatcttatactttatgaggataagaaataaccgtgatagcacgattctccagcaaccatctctgtgtctctctaaatatacgaatatgcatacacacactcacacaggcacacaaatggaaaagtctaatatttatcaataataatttataggatttccaaatgagatgaaaaatctcattattttgtaagaaacagaaatgacaacattttaatttagtaaataaattcttggaattcacaagacctatcatataaaaactttaagcttctctctaaaggagactatttgtaaaacgtatcaattttacatatttcattatgccagaatattcacttggattttaattatttttcttttaatacatttttcagttctcagtcatactaattttgaataataaaattttcccttggatttctctagggccattctctgccttacataccttccacaaatctgaaatataaaatttggcagatccatgcacaccttctcgccaagcgcggtatctggaataccaaactagccatgggtttaattcataaccaactgctgtgaaccctttcttcgcagccgctatgacctgtggagagaggcaggatttattcaaaataagaagaaaaaatgaacatacatggtcaaacaatatgaatatttcctatcaatggtttaaacatccaatcaaaaagcacctcccgtgactaagacatcattttaaaatgtgtctctaaagcgatatagctttgtggacaacgtaatagtcaacccatgcaacttagtttccttgattggttaaagacttcacctcaagtatcagaatagacattcaggttcacttggaacacctccataattgattctaggtcagccaacccccggggaggtcgaacaaaacattgctgaaaatccactgcatctctccatcagtgggctagcacagcagcagtgaaatgaaagtgtctgggaggatggttttgtgaacaagtaataatatgcaataaaaataacctgtcaatgaaaaatctgcaattagttacatatttcctttgtagttaatgactgtttactcaaaactgaaaacaggtaaaagtaaaatgaaatgaatcccaataacgtcaactgtggaatcccactggcctccggagagtgggagggatgtggggcagtcctgggttctctctgcctgttctgtcctgccccattctttaagggagcatcccttgactcagctgtcccacctaagatagttcccaagtactacagtgctgcaagaaaacattttctcagaaaccacagatactcttcaaatacgtaaagcattcaaatatgaatttcaaaactttctccttgatttattgatatggtttggctctgtgtccccacccatatctcatcttgaattcccatgtgttgtgggagggacctggcgggaggtaactgaataatgggggcaggtctttcccatgctattctcatgacagtgagtaagtctcacaagatctgatggttttataagggggagtttccctgcgcaagctctctccttgcctgccaccatcaatgtaagacatgacttgctcctccttgtctttcaccttccaccatgattgtgaggcctccccagctgtgtaaaaccgtaagtctaatcacctctttcttttgtaaactgcccagtctcaggtatgtctttatcagcagcatgaaaacagactaatatatttcttttttttttgagatggagtctcgctctgtcacccaggctggagtgcagtggcgtgatcttggctcacttcagcctccgcctcccaggttcaagcgattctcctgcctcagcctcctgagtagctgggattacacgcgtgcaccatcatgcctggctaatttttgtatttttagtagagaaagggtttcaccatgttggttaggctggtcttgaactcctgacctcgtgatctgcccacctcagcctcccaaagtgctgggattacaggcatgagccaccacacctggccactaataaatttcttagaaacaaatagtggctcccagagggtgaggggaggagaggagtagaaagttattatttaatcggggcagagtttcagttttgcaagatgaaaagagttctggagatgggtggtggtgatggtggcacggcaacgtgaatatgcttcacaccccgaaccgtacacctgcacatggttaagatggtaaacactacggtatgtgtatcttaacacaattttataagtaaaaaaaaaaaattaaattaaaaatatcttaactttctaacctcctcgtgattattctagctcagaatcacaaaatcagtctctatgtctgtaggagccggtgaaaggtgatagagtcctgctggccttcacactaaatgcttccatagcaccagcctttcccactgctgctggaacttttcagcttatctctgggatgaggctaaggatggtgccaccctgcccacagaggaacctgctctgagacacccacttgcccatcagtggccttttatttataggtgcccaactgcggtcaagtgagagaagttcataaaaagactgatcttcggcttagtgagggttaatcactggctctttcttaactctgtattaccccaggaattattacttatacatggataaatacagacaaatgcagaagcaaacaactatggggcaaaaatgtaaaggagtgaaatgccatgatttaacatatttcttctcatgccacctctgttggcccatgtattttaagagacaatttgataattaccagttaactgttctttttcacctggcatgtttacagcacacttcctcctttaagaacaaattaaatctgggaaaaatgaattccaaacacactggtagttgaatagtttggtcaaacaaacataaaatgaaatgagcactctttcaagctgtcagatttagttaagtctttgtgtaagccttactaaatgtaaagcagaaattttaagttctggtttcaaaccttaaaatgttttagcagaactcacaatgcgtccgtccccactaccgatgtccacaagggatcctcttcggcatcgcaacattttcacaacattttcaatctgcttcgtagttgcaggtacaaacggcaaacagacttttcgaagggctggcgttacaaacggcgtggctacagcgtacacagccaccagggtgccacccacaagcccagtaagtaagaacccccagttgcttttctgcaaactgttgacttcaaaacttgcaggtagaacatgtcttgactgactttcttctttaagtgtttctaggggtatacctagattgaaagcaagcagaagagacacatgtagcaccaaatctgaaatccaagagagcatttttttctacaattctcattggcaaacaaactcatgctttttaaaggataatttagctgaatacaagctaaatgtcaactgtaggatcccacaattagttctaaatcctattaaggtattttgaagaacattattcaatactatgagaagactaaaatcttttctttccaaagtactgattttttgtgtgtctaggagtcatccttacaaaacaatgtattcaaacttatcgagtaatttattaatttaatatccattagtgcaagttttaatcatgcactacatatttttatgttctgaactaacaaagcctcataaacaaataagcataaagatgtctaattattacccaatttcaagtagaattaaaggattccacatcaaatctggtctggcatctacaatccagtttcaccaatacaattttaaagtaatagaagagacaaaaatcaggttttaccaaatatcttaaataagtatggtaataaagagacttttacagcggatccaaaaagaacaaaaaataaggccgggcgtggtggttcacgcctgtaatcccagcactttgggaggccaaggcgggccgatcacgaggtcaggacatcgagaccatcctggctaacatggtgaaaccccatctctactaaaaatacaaaaaaaaaaaaaattagccgggcgtggtggcgggcgcctgtagtcccagctactcaggaggctgaggcaggagaatggcatgaacccgggaggtggagctgacagtgagccgagatcgcaccactgcactccagccggggtgacagagcgagactctgtctcaaaaaaaaaaaaaagaataaaaaataagatcatcattttagtactatcataaacataaaataacgcagaccccaatcactgattacaaagaaatgaatggtaccttaaatatccttttgagatttgtcctttaaaatgcatttaaatgggatctcaagattttgaaattaatattgacaaaattgattttaaaattgattaacaaggagcacagtacaggaggtaaaagcaggactcctccagagccagccaaagttaggatcccagctctgccacctcactaatgatgggaccctgaatccctggtccttgctgagcctgttttctcatctgcaaagtgggggtcacagggatattgtgaggatgaaatgagtgtatggaggtaaagcacttagaacagggtcgaatgcagttataggtttcctataactgctgtaagaaattgtcacaaaattagtggcttaaaataacaccatttatggccaggcgcagtggctcacacctgtaatcccagcactttgggaggccacggcgggcagatcaccagaggttgagagtttgagaccagcctgaccaacatggagaaaccccatctctactaaaaacacaaaattagccgggcgtggtggtgcatgcttgtagtccccagctactagggaggctgaggcaggagaatcgcttgaacccgggaggcagagcttgcagtgagccgagatcacaccattgcattccagcctgggcaacaagagtgaaactccatgtcaaaaaaaaaaaaaaagaaaagaaaatcaccatttattatcatacagttctggaggtcagtctgaaatgaattggcaggcctgcgttccttctgggggccctcgggcaggttttcttgtctcttcctgcttccagaggctgcccacattcctaggctcttgaccccacatcactccaatctctgcttctgtcctgacatcaccttctctcacatgcctggctccctcttaatttataggaaccctcatgataacactgggcccacataaataatccaaaataatctcccatctcaagaccactgattacatctgtacaggtgcaggaattagaatgtggacattcctggagaggacatttttcttcccaccacacccatgaactacggcaatctattctagtgcagtacaaatttgaacccaagacacacagaaagctggcacacagcagtgggtcaccctcagggcagccagccaatcgccagcatcccccactcagcgcagctttgttcttgattcctgaagccccttaaaatgagttgtaaaactgatttcacagtggaaaacgaactgggtcggcggagggggcggtgggaggaagaatgctactaatgctagtgctagtattaatgctagtgatgggggtaaagaaaattaactttaagaaggtgatggcatttgatagaaagcaaaagctttaaataatttcagttataattttggcattttacggaggaacttacaggcataccttggaaatatttagttccagaccactgcaataaagtgagtattgcaataaagcaagttacacaaatatttttggtttcccactgtatataaaagttatgtttacactatactggagtctattaagtgtgcaattgcactgttcaaaaaacaatgtatgtaccttaattttaaaatcctttattgcttgacattttggtctgatttatcttcgaaaaattttttttaatttttaaaaaagagtttattgctaagaaatgctaatgatcatctgagccttcagtgagtcataatcttttcactggtgtaggatctggccttgacgttaatggttgctcaatgatgagggtggtggttgccgaaggttggggtcgttgcggcaatttttgaaaataagacaacaatgaagtttgctgtattgatagactcttcccttcatgaaagattgctctgcggcatgtgatgctgtttgatagcattttacccacagtggaacttcttccaaatttggagtcaattttctcaaactctgccactactttatcaactaagtttataaaatattctaagttctttgtcatcatttcaacaatgtttacagcatcctcaccagtagtagattccatctcaagaaacaacctcccttgctcatccataaaaagcaactcctcatccactgatattttatcatggggttgcagcaactcagtctcatcttcaggctccacttctaactctcttgctatttccaccacatctgcagttacttcctccacttaggtctcaaagtcatccatgaggattgaaatcaacttcttccaaactcctattaatgttgatactctgacctcctaccatgaatcatgaatgttattaatggcatctagaatggtgaatcctttcctgaaggttttgaattgactttgcccagatccatcagtgtaatcactatctattgcatctctagccttacgaaatgtatttcttaaataacaagacttaaaagtcaaaattacccccttgatccttgggctacaaaatgaatgctgtgttgacaggcatgaaaacaacattcatgtccttgtacaccgccaccagagcaattgagtagtaactaggtgcattatcaatgagcagtaatattttgaaaggaatcctttttctgatcagtaggtttcaacagtgggcttaaaatattcaaaaatcatgctgtaaagaaaggtgctgtcatccaggctgtgttgttccatttatacagcaaggcagagtagatttagcatcattcctaaggactctgtgattttcagaatggccagtaagcattggcttcaacttaaagtcaccagctgcactgacccctaacaagagagtcagcttattctttgaagctttgaaaccaggcattgatttctctctagcttccaatagaaggttgtttcatccatattgaaaatctgctggccaggcacagtggctcgcgcctgtaatctcaacactttgggaggctgaggtgggcggatcacaaggtcaggagttcaagaccagtctgaccaacatggtgaagcccagtctctactaaaaatacaaaaattagccaggcgtggtggcacgcccctgtaatcccagctactcgggaggctgaggcaggagaatcatttgaacccgggaggcagaggttgcagtgatcaggccactgcactctagcctggatgacagagcgagactccgtctcaaaagaaaaaaaaaaaagaaaatctgtttagtgcagcaaccctcatcaacaatcttagctagatcttctagataacttgctgcggcttctccatcagcacttgctgcttcaccttgcattttcatgctctggaaatggcttatctttccttaaacctaatgaacctaccactgctagcttcaaacttttcttctgcactctcctcacttctctcagccttcagagaactgaaaagagttagggccttgctctagattaggctttggcttaaagatatgatgtggctggtttgattttctatccagaccactcaaacttgctccataccagcaataaagctttttcactttcttatcatttgtgtgttcactggagtagcacttttaatctccttcaacaactttctctttgcattcacaacctggctaactgtttgatgccagaggcttaattttcagtctatttcagttttccacatgccttcttcactaagcttaataatttctagcttttcatttaaaatggtagaagtgtgactcattcacttgaacacctggagcccattgtagggttattaatcagcctaatttcaatgttgttgtgtctcaggaaataggagggcccaaggagatggagagagatagaggaatggccagtgcagcagtaggaaaacacacatttatcgattaagttcactcttatttgggcatggcttgtggagccccaaaacatttacaatagaaacatcaaaaatccctgatcatagatcaccataacagacataaaaatagtggaaaatttgaaatattgcaagaattaccaaaatgtgacacagagataaaaagtgagcatgatgctgttgaaaaaatggtgcgaacagacttgctccacgtagggctgccataaaccttctgtttgtaagaagcacactactgaatggggcatgttggttcatacctgtaatctcagctactcaggaggctgaggccagaagatcgcttgagcccgggaatttgagaccagcctgcgcaataatagcaaaatcctatctctaacaacaacaacaaaaaagtgcactatctgcaaagtgcaataaaacaaagtatgcctctgtttgctcaagtggtagtcatgcatttatttaagaaaagtcggccaggcacagtggttcatgcctataatcccagcactttggaaggccgaggcaggaggattgcttgaagccaggagttcaagagcagcctgggcaacatagcaagaccccatctctacaaaaaataaattagccatgtgtggtggcatgcacttgtagtcccagctttttgggaggctgaagcaggaggatcgcttaggcccaggaggctgaggctgcagtgagccgtgatcgcaccattacattccagcctggacaactgagcaataccctggttgtcaaaaaaaaaaaaaaagaaaagtcaaggcacatttgtacatgtgtcatgccctctgtaaaaaattatcttgtggacattccagttgtacagtacagcagttaagaggatttgggttacacagttctggagtctcagaacttaattagttgtttaacacaaggtaagttgttactaaggcatggttttctcctcagtaaaatttggaaataatttgtttaaacacaattcaagctgggcatggtggctcacgcctgtaattccagcactttgggaggctaaggcgggcagatcatgaggtcaggagattgagactatcctggctaacacagtgaaaccctgtctctactaaaaatcaaaaaaattagccgggcatggtggtgggcgcctgtagtcccagctacttgaaaggctgaagcaggagaatggcgtgaacctggaaggcggagtttgcagtgatccgagaccgcgccactgcactccagcctgggtgacaaagtgagactccgtctcaaaaaataataataaaataaaataaataaacacaattcaaaattggccagccacagtggctcatgcatgtaatcccagcactttgggaggctgaggcgggtggatcacctgagctcaggagtttaagaccagcctgggcaacatgtcaatacctcatctctaccaaaaatgcaaaaaattagccaggcctggtggtgtgcatctgtggtccctgctacttgggaggctgaggtgggaggattgcttaagcctggcaagtggaggttgcagtgagccgagatcacaccactgtactccaacctgggtgacagagtgagacctcattacaaaaaaaaaaaaaaagattttgcaataatactatcctcataggattcttggaacaggtaaataatgtaaacaaagcatttagcacaagcctgagaggctaagtaatgactattaattgctattattattctcaatactatcatatgcaaggaggggctcaatttttaacagctttgagatataattcatatacatacaatttgcctgcttaaagtatataatttaatgtttctttttatattcagatacatgcaaccatcactacagtcaatttttgaacatttttattacctcaagaggaaaccccttatcctttagctatcacccccgcatccaccctctatcccccagccctaagcaaccactaatctactttttgtctcaagaatcccctattctggggcctggcacagtggctcacgcctgcaatcccagcactttgggaggccgaggtgggcggatcacttgaggtcaggagttccagaccagcctggccaatattgtgaaacaacaactctactaaaataccaaaaaaaaattagccaggcatggtggtgcacacctgtaatcccagctacttgggaggctgggggcaagagaatcacctgaaccggggaggcagaggttacagtgagccaaggagccaaaattgcaccactgcactccagcctgggagacagaacaagaccctgtctctcaaaaaaaagaaagaaaaaaaaaaaaaaagaatcccctattctggacttaaaggaatggaattgtatagtgtgtggacttctgtaactgacattttttacttagcatgtcttcaagattcatccaggttgcaacttgtatcagttctttatttctttttatggcttaataatattccattgtatgcatatgccatatttttgcttacgcatttgttcaccaagtttattaaacaaacacaagtcagatgacccaaatttcatttttcacctgtgtagatatgtacctttcaattcaaccagcaaaagatgtaataaaaagttcctgttcttcacggcctcccatctaggcagatgaggggtggggtccaggagaggcagacacagggctggttgtgagaaatgctataacacaaacaaaacgctacaggcatatgggagaggcggaggaaagactgattccaacaatgggaccagtgaggtgttggcagagagaatatttgagctggagccaaaagcagcaagccttggaaccaaggtgtggaaggcagggaaagcctttctggagcacagagtgagagacaaacaggaaggcaggcctctgaaggccaggctgaatgtgtattttattctatgtgcactgtgatgaaactttttgagcaaagtcaccataatatttgtgtttttaagaaaggcaacacaggggcaatgagtctcttgatgaaatcattctattttctgtcccaggttttgatgcctgcaagtcttgcaacgtaacaaacatttgcatggggaaatcaagatccatacccattgctggagctttggaagaagttactatgtacatccaatataggatgtacaatataggaactacattgttagctccattcaggaaaaacaattgattcctttttgcgatggggtctcactctgtcgtccaggctggagtgcagtagcacaatcacagctcaccacagccttgacctctcaggctcaaacgatcctcccacttcagcctcccaggtagctgggactacaggcacatgccaccacacccagctaattttttaaatttttttctttagagacagggtctccctatgttgcccaggctggtctcaaactcctgggctcaagcaattctctcgcctcagcctcctaaagtgcctccatgccaggacctgtattgattcttatcagtaaaaatcaggccctgaatattcaaaactaaaatcaagactgtttctacaaatccttctaacggaacatgttcagactcccagactatcctatatataaatggcaagaactttctttcaggtgttctttggaacaaggagccattctattaaataatggctgcagtggccactggctactttcattgagcacttagtagtccatcctttaaagtcaaacacagaatgaggttaacttctactgtgtccgggccctgcttgcttattgacttctaatattggttgaaaacttcaatttttagtggcagatttggatcagctgaagctagaggcagtgacagatgtacaataaggtacccaaggttcttatccaagttcaagccaaaagaaaaaggccaagaagagagaaggagcctgttaggaatagtaactagccacgtgtttaaagcgggcttatatcagaatgtcacaactcataaggactgttcattgtgcacttgtatgtgcatacctgtttaataactacagcatatgttatgtccctttagcatatattcttatgtccttaagaagcctttcttatactagtctaatgtcatttgtgtccttttgacatacatgagctattgatattaggaaaaatcctctctcactccccagtgttttgacagggaatcaactacacagaggatgccataggacattctatttttcacaacaatcgaaggagccaaatgaattgcagaagtcaccatttttaatgaggaaacactgaattggcaaagctaacgtgaaataagacctgactccaaaatctaaaatgtccttgaagaacacttcaaggtctagcgcgtaagtatgccaagcatgaagagttaacagatcaccaaccatcccatgacagtcagtcctccctgtttttagagacagaatctcgctctgtcgcccaggatggagtgcagtggcgcgattatagcgcactgtaaactgaactcctgggctccacccatcctcctgcctcagccccagagtagatgggaacacagtcgccaagtctgttcttgagtttcaggacagggtcaaatgttatagtgcatgtattcatttcagcacttattgagtgcctaataaagtctgggaataatacaactttattagttaagtccctgcccatggcagtaggggagaagcaaggatggaaaccctcaacaaataaatctaaacctatcaaatattaagtcatgatcttggagggcggggaggaaggcagcataagagatttagaggacagctgcggttgccaagatctttctgaggcagcataatacagggcttaagagtgagacctgccgggcaccgcggtggctcaggcccaacacttggggagacctagacgggtacatcacttgaggtcagccgttcgagaccagcctggccactacggcgttaacaccgtctctactaaaaatacaaaaattagcgagcgtggtggttctgtgcctgtagtcccagctgcctgggaggctgaggcacgagaatcactggaacccgggaggcggaggctgcagtgagccgagaccgcgccactgcactccagcccgggctacagtcttgtctcaaaaaaaaaaaaaaaaaaaaagagtgtgggacccattgcatcaggctgtgtaactgtttcttactagctgtataccagtggcaagttactgaaccatttgtgcaaaatgttaatttatttaccaacactgtgttcagcttgccaggcaccgttctccttgaatctcacagcagccctgtgagtaggcactactgttaccaccgtcactttgcagacagggaacccgagggacaaagaagttaagggatttcctcaaagccacagctaggaagagcggcagaactgcgattccaatccatcagtgtgcctccactatccctattccttaagatcgtgccaaaggctgagtcacttgcactaagtagcctagaacagtctctggggaaacgcgcccgccgacaaggatcgccagaaccggcgcgggcaccgcgcggcgaccaggagctctggtcaccgaaggccaggctggaggccagagcagccgcccgcacccggtcaccgcctcgacagtggagacctcagctgaccgcgagcccccggcccgcccgcaccccttctcatgcccccaggaacccgccaagccgctccagcctcacctcctcctccctccatcgcgagatttccaacagcgtttttaaaaaaaaaaaaaaaaaaaaaaaaaaaaaaaaaaaaaccggaaatgggtcctaccatcttctcggagccggagtgcgaagaaataaagaaatagtgctttaagtcaatgaattcctccttgggacccactatcgagaaactatcagtggtaacgttttaaaaaatgacaaattcaatctgctcttgacttgtgtgtcctaagatttccactaagtgtcttcaaacctccccctccccggcttcctggataatagaagttcccgaaggccgccgattccagaagatactgtctggcgtgaaattagtctcagtagaaacataagtcccgcgcgtcttgtgctgcgcgtgcgcaagcttttgggccctcccgagaaagggaagtgcattctcgcttccgtagcggtctccgccggttggggggaagtaattccggttgttgcaccatggcgtccatggggaccctcgccttcgatgaatatgggcgccctttcctcatcatcaaggatcaggaccgcaagtcccgtcttatgggacttgaggccctcaaggtaatggcacagggacctgctcgcggtgggctaaggggaggtggccgaggccgtggctctgcgcctgcgcgagttgaggagcggctctgccatgtgctccccggaaaggtcgagaatctccgtctccctgcggtctccggccgctcagcccgcttactgagctcgggagacgccggcgcctaatcctgggctcggaatgtgggggccagccaggctgggccgccagcgcccttcggagctgggtggggccgctcagtccggtcgcccgcgggagcaaagcgggaccgcctccccgcccggctcctccagcctgacggccgcgtgggactgcgctccagtgggagggcgccggggagatgctctgtcacctgtcggttaaggcgctgctgcttaacctttcgctggtccacccgcaacggcccttccgttttctttgtcactcgtaaaggtgtggtcacttaacagggtatttcatttctgagtgcttttttgcccacccttgaggaaaaatagcgaagagtgaaaaacggacgcacataaccgtaatacaaggtggtgtgcagtgagaaggacagctacggagagggtgcacataagcgtggtgctggaggacagctttagatcggggtgagaggtagcattctagggagaggaaacggtagaagtaaaggcttgggcaagaatgcgcatggcacgttgtagaatggaagagccatccggttttaatggagcactgacttctttaacttacaatagttcccgaaggtggaagctattgaatgcccaacatggaaaatacgacgttatctttggggaagaaggggagccattgagggggttttgagcagaatttcagtagagctgcacttcaggcagcaaagcttgagatagaccgaagggaataaggaagaccagaggggttaaagaaaccagggcaggggtgcaggtaagaaacatctgagcaccagacgttgacagaaaatgcagaggaagggacactccgagagggccttcagggtttgttataaagtgaattcataatagaccattccactaggtctctcaggtgtccctgttcacttagtgtcttggaggtttacttacgcaaagttagaaacaatacagttcccctatggactctttgtttgacttagtgctagttacacaacctcgcggaacctccttttccagggggaggtgataggcctccgtcaagctgaagacttgacagtgatattaaatggagtgacttagaggggctgcacagtggttgatccacggtaggcactcagtatttgtttcctttctagaaagaaaaagtttcaagctaattgtattatgtattccattttattttccacttaacagggacctgcagagaaaataacatccaatacacacacctggtgtaacaacataactaaaactaggttgttttgcatcagccattttgttcaaactgcatgcatttgtgcccagaagtcgcacactctgagacagggttattttacaaaactggggacttgggcccagagcagttgagaaattgttctgaagagcagttgctactaaagagcattaccatggtcagggccaccgctgtcagagtcaaagccagtggtctagagcagcattctcaagtttggcatattgacattcgaggtcggatcattctttgctgtgggagctcatttggacagtaacctgggtgtttaagtctcttaaaagagttggatgctgttggtaggcatcctgtgagtgttgaggctcagcagtttagggatatacacttgctccctgacctcatagaacgtccagctaacttgaagaaccaaaatatatggaaattgaaggcaacggtaaaagaaatgtataggccaggacgtgaacgttttaatggtaatggtcacagttctttctctctggtcatttagagccttaaaggtaatatgtattttgttgagattcttcacttgtttaacacttaactgtataatatttcaccttaaaaatgcaggcattgactgggcgcggtggctcacgcctgtaatcccagaactttgggaggctgaggcaggagaatcgctggaacctgggaggcagaggttgcggtgagccgagatcacgccactgcactccagcctgggtgacagagtgagactccgtctcaaaaaaaaaaaaaaaaaggtgcaggcattagttggcttaggaaggaatcatattctaaaatcctgtaacctaaaacagagcaggctaagtttccaggccagccagcataattctgttttatccataatatgtattatgccttgatgtttgatactcttccctctggaaacacacagaactagcagaaggaagaaaaaggttttttccacgttgccgagcagtagggcaaaatagatctcgggatttcgggatctctcctatttgccaaattctttacatccttttctttctgcctcttgctttctccttaaaaataataataataataattctattactcaatttggtagctaaatgtgaaaaaaaaaacaggtaacttttttattatcactttgacagctacttaccttccttaagagggccagtttcagccgggcgtggttgctcaaacctgtaatcctggcactttgggcagccaaggcaggtggatcacctgaggtcaggagttaaagaccagcctggccaacatggcaaaaccctatctctactgaaaatacaaaaaaaaatgagcagggcgtcatggcgcgtgcctgtaatcccagctactggggggctgaggcaggaggatcgcttaaacccgggaggcggaggttgcagtgagctgagatcatgccactgcactccagcctttttgagacacagcaagactgtctcaaaaaaaaaaaggccagtcagtaactttgatctataaatataattattgggatttcaggtgggtggaggaagatttttaaagcaagagcagtttttctttttattttgtaatggggtctcgccatgtttcccaggctgatctcaaactcctggcctcaagcaatcctcctgcctcagcctcccaagtagggggggttgcaggctctagtactgcatccagctcaaaagattacaattctgcagtaaatcatagtgtgacagtaaggtgttgtatgtttacagttggactgtttctcatgagtacaggcccctccttgtctgcagatggggaacccgcagatgtacaagcctagatgcaagggacttgagcatctgtgaatttgggtatcctcgggggctcctggaacctgttccccatggatgctcagggagaactgtggctcctggaaccaattccccatggatgctcagggaggactgtgttgcacagtggtcttgcaacgcctgtaaggtcatagtcatactgtccctcttctcagctgtaaatgggctggtaaaagaatctgtctcattaatgtgttgaaaattcagtgagataacacaaagcacttggttctctttctttacgtaagaattgcttattaaaactggagtcgtaaatgttataatacttaaacctgtctgttgccccttaaatgtagaagcttctagacaatagaaactaagtcataagtgatttttgtagtcatcagatgtgtgcttttaaccattgaaattatatgtaacagtgtttgctttttctgtttgtttcattagtctcatataatggcagcaaaggctgtagcaaatacaatgagaacatcacttggaccaaatggtaagagtccaccattccgtgttttttagcaaaagatttaaattataaaactgtcaatataaacctctctacagaaaggtggagtattgaggggaggcatcttacttccttaacacagccaaaattttttagtgtatttcaggtttcttaaacatggttataatcgtgtgcaatattaggtcggacctttttttttttttttttagcatgtaacatcatttcattagcattttccaaatcatagttgtcttttgagattaacattatacttaatgatgctccataatgttttgccaattatgttagccaatctaaaaatgccttcatgcagctactattttgtgtatgttgcattatttgtatataataaattgcacagataagagctgggtcaggaggtcttgttttatagtttgtgatattggttgccagttttttgcgcaaagcctactaaacgttgttttttagggcttgataagatgatggtggataaggatggagatgtgactgtaactaatgatggggccaccatcttaagcatgatggatgttgatcatcagattgccaagctgatggtggaactgtccaagtctcaggatgatgaaattggagatggaaccacaggagtggttggtaagaaaagacaaaacatcctttctcatttaagagacgtcatttaagaccacagggctaacatgcctgctgagattgttgtctctgaatcagagcatgaggagacagacaaatccaagttgaaaacatgctacaaaacaaatgtcggactttcaaaactgacagtgttacaaaagaacagaaagagggctggggattgttaggcatggagaaatgtgtaatgattgattggacactgattttgcttgtcttttaagctataaaggatgtttgggaaacgtggaagaatttgattttggatcatgtactgcaatgctgagtttcctgagtgatctgtgaccattatattgcagatgtgtaggagaatgcccttcttctcagctgtatacctaaatacttaggagtgacatgtcatggtttctgtaactaattctcaaatagttgaacagaaacagtatgtacatgtagagaaaatgtggcaaaatgttaataagtaaactggtattcgttttagtattgtaccttttttttctgaagatttgaaatctttaaaaagttggggagattgaagacaaaatatcagtaaggttaccttttctgcagatgaaatttgaattcattcaacaaatatttattggatactattgtatgccaagcactgttctcggtgcgcttggagagctgtagatttaaacaaaattcatctttgcgaccctaaaatgaggagaaaggaggatgggggtggggggaataaataataaacacgttttagtctcatcaccaggctgaatttcactgagtagaccctggcccaggaaacataatagctttttacctcttagaaaaatgttctttttacattatattctttagttacgttcttcacatcactgagggttgaatgttcatctgtaaggggacacatgtcctattcgaccttcgctagaactaaaacgaggctttcttttaaaaatagagggcttctgcctctaagatgacttgcagcttaattctagaagctgcttctttccatgatagcatctaacttgtgctgattatactaaaagtgaagttttgttgtttgcctgaactgattgtctgctggcttatttgcagtcctggctggtgccttgttagaagaagcggagcaattgctagaccgaggcattcacccaatcagaatagccgatggctatgagcaggctgctcgtgttgctattgaacacctggacaagatcagcgatagcgtccttgttgacataaaggacaccgaacccctgattcagacagcaaaaaccacgctgggctccaaagtgtacgtttcagtagatgatatgattacccatttgtagaggaggcagtttgtttgccatttcttaaaggcaacacaaaatgaccactggtggatttgtatcgatttgattatttgttttgattacttggttttgctttgtttttaatgtagatgtagacagatgcattttgtatttaagttgagaactgaatttctaagttcaggtataaatccccttgacaatatttgcaaaatatagttattttaatttagcagaataggttgtgttaaaaatcagctaaggctggatgcagtggctcatacttgtaatctcagcactttaggaggccaaagcagtagcttgcttgagctcaggaattgaagaccagccagggcaatgtagtgggaccccatcgctacaaaacaaaaaactagccaggcatggtagcacacacttcagcaactccagaggctgaggtgagaggtcgaggctgcagcaagccatgatcatgccactgcactccagcttgagcaacagagcgagaccctgtctcaaaaaaaaaaaaaagtcaactagaaagggtcctacctggaggatatgtgaattttcttaacacttctttctataatttctttgctggggagccattgggggtgggttccactttttattcagcaaattgccgatccaaaattataatttagtaaagagagtcttgaaagcgacttgtctctggtgttttcagcgttcgtgtaatgtccgtttgccaggcttactgccaggtcttatgggcactaagacacagctcttctcccaggagactctaagcaacctcagccaaggggtgcgctgattatgtacaatgccaaagacttaaggtctgttgccgtaatataacataaaaatccagtgtaagctgctttattacattatattaaatcagtgagagatgttttcaattgtgtgcttgtggtggttttagcaaaaaggaatgagggatcttctaaactcagagtagtcagggaaaatgcaggaaaagtgtctgcttctgttgccttttcccctgagcaaagcctatgttagagcagaagccttcagcaatgcctgctgtcctcctctaaccacagatctcagcagagactagctccctaggcaagagtgagtaccctaggggtagcctcttgtcacaagtataacacttattttctcatgaaaggaggacatcatcattacttgaagtgtacaaatcagttttcttgttgctttataagttggccttgttctgtttgcaagtattaagtcatctacttaagatacaacatgtttactttcatggttctcttttatagataacctgtgatttcagacattatttcaagtgctaggtttccctagttgtttttcttggctcaaaaattaatttattgaactgtctattcacatgtttcaaagctttcaaaaaggtaacaccctccatctataatggatgttgtggtgaattcttggaaagtttaaatgccctgtccagtcctttcagttcctggttagtgctacacttcattgagataagagtgactcttcctgagtgattacttacctttcccattctgttctgaacttgtaaaatagtaacagtattctgtaaaagtgctgcattctaagaagaccttaattcatgccagactacagtggtttcttgagtacattcataatggaaggaaatagtaaatttcagagttagcgaaaataaagatgtaattttttcctatctaagtatacagtcccctttagggcccatggatcacaggttaagaatctgccccagactgttgaaaatgcaggttgagatggcattcccctctagaagactcaaaacatcgtttgatttatatctttgagtaacattgtgttatgtggcctgctttggttgcagtaattgtgaaaccaatgaagtttgttttgtggtgttttcctcagggtcaacagttgtcaccgacagatggctgagattgctgtgaatgccgtcctcactgtagcagatatggagcggagagacgttgactttgagcttatcaaagtagaaggcaaagtgggcggcaggctggaggacactaaactgattaagggcgtgattgtggacaaggatttcagtcacccacagatgccaaaagtgagccattgcatctcacagcttcgcactgttggttaactcttaattccaccaattaaaatgtctttatgttcccccatagaaagtggaagatgcgaagattgcaattctcacatgtccatttgaaccacccaaaccaaaaacaaagcataagctggatgtgacctctgtcgaagattataaagcccttcagaaatacgaaaaggagaaatttgaagagatgattcaacaagtaagtcttaccagagtcctcagtggaatttaaactcccaaagggtacagttagttaggtttggttagtaaatatgtgtagtctttcttcagttctaaaacatacacaggaaaaaaccaaattgcatagaaaggcataaacagggaagaattctaattttgtcttaaaatggtagcgtgttcaggccaggtgcagtggccatgcctataatcccagcactttgggaggctaaggcaggcagatcgtgagatcatcgagaccatctgactaacacggtgaaacgccatttctactaaaaacacaaaaaattagccaggcatggtggcaggcacctatagtcctagctactcaggaggctgagacaggagaatcgcttgaacccaggaggcagaggttgcagtgagctgagcttgcaccactacactccagcctgggcgacagagcaagactctgtctcaaaaaaaatggtagtgtgttcagggtcctgaaagaagtgaccctgttacctaaagccgtgctttcaattgtacatattatatttgccgtcctggacaaatttaacttagcttaccttgcctttaagatttctgactataccttttaggcaagagttaatgagtaactggagttaaaccagaatgcactcatagtaatcccagttctttgctcagttaagtctagtttgggttcatgaataccttagcgtaggtgtgctttctctctgacatagcaactcctctttgggggctgcgtccttgggagttgaaaacaccagtactcaagaagacaggaacgtgggttggttagggtattatttatcatagcaaaccaactagagactattttcatgtctgttcttgggaaagttgttgaatgtactcattgatgatacggttcttggtgcctacgacataccaggctctgttgtaggcactaaaggtacagcagggaatgaagccaagctcgtgctcttgagacacagataagagaaaggtgggtacagctccattacagacactggtcagagaggtgacctgtaaggagaggccaacatagggtgagagcagtgcccctgggggaggagcattccaggctgaggacagatggggatgctcctgagccaggaacattgttggcttgtacaaggaagagccagcctcagggattgaagcatgctggcgggagcttataaataaaaggccatcatctgggccggtgggacagttttcatgagaatggtgcctcagctgtgctggggggccacagataaattgagaggccagggatgttactggatcgtgctggtgaggcgcaggttgctgagaatgagaagggaatgacgatggggctagatagtaaaatgttaaagaatgagaggcagggacccaaagaggaacactgcaggtgactgaggagcaagaaggaccctctcctgttctgagcatgtgagagggaaagcagctgccatctgaggagggttgcaggggcaggttggttttccggggttgtgacggagagattgtataaggaggctgctgttctggactgagttccagagggtcagggaaggaagagagggagagccaggcagtagcaggtagcctgggaggcctgatggagacaggtaagccagagttgtggggcacggtgtggcagtcccaggtgagcaccagaggtggggtgggcagcctgatcgttgccctcctaattgggaaaagtgactttgccatttgcaggtcggggtgagggtgcttcttactggaagcagggttgcctctgtgagtgcccgaattagtttatggatccactgaggattgtccactcaggtgagacagtcaagttgcaagtggttcataacattgtttgtttaaaacatactcaggtgaaactactctgtaggtgtttgtgacaggacagagctgttagccatttccccatggttggggaagggtgttagctttgttgacgtttctgtgggttttgcctcactgtaacaatagggttcagcagaattactgcttgtggtttttaaagcataaacaatgaggtgatccccattgataaaatattcactatttagaatttggaactgacagaaaagtggacacttgtctatttccttccttctctttcctttgcttttgtgtttgagtgcacctgccttacacccaactgtgcctctccttttttcaaacattgtaatgaagaataaatacccactttctcttaatacgattgtggtggttcttttcccagattaaagagactggtgctaacctagcaatttgtcagtggggctttgatgatgaagcaaatcacttacttcttcagaacaacttgcctgcggttcgctgggtaggaggacctgaaattgaggtaggatgttccacgtgaagagactttgagaagtaggggttcatcttatgtgttgaggggtgttttgatagccctgccttaaataactgcatcacaccaaggctggcagatgaggggagggtgagctgggagagaggaaagcgctggaatctttgttactgtttggataacagtgctgtgtgtttctggtgttccctggcattttgaaattctctccctgtgttgtctcacttggccctgtcgttgacttactaaggctggaagacctggtctcatccaaatactaatggcagtcccaggcaacggtgcctcggtggttctcactgcagcgcagtgcaaggaacatgcaggctgggttcccagagtgagggagggctgcacagatgggagatgagggtatgagcttaggggacgggcgccgggtgatagatctgggcagcaccaaagccccaatcaagacgtccagctcaagagccttgttacctagcaaggtgctttgggttgaactggagatgtctcggtcaaagtggggcagcagttctagtgaacaagttggtcttagatcaagttttgctcatttgtggcccagttttgaaagttaacttcaccagtactgtcttcatccttctccctgaccaccccaattagctgattgccatcgcaacaggagggcggatcgtccccaggttctcagagctcacagccgagaagctgggctttgctggtcttgtacaggagatctcatttgggacaactaaggataaaatgctggtcatcgagcagtgtaagaactccagagctgtaaccatttttattagaggaggaaataagatggtgagaattcaactatttgtcctatactgttgcttattttgcttcatggtctggcttttttgcctgtgtgtatttaacagagacacagtcaccataagaaaaataatcgtggttctcaaacaatgacgtatcatggtgtaaaattactgaagaccatgttaaattgttaatttcacaaggcacatttgcctttctgctgtcccttagagtatacaatatacactatgagatttttatatctttttaaatacttaaacacagtttaaatattcaagtcctggattttagaatgtttgatacagttacattaggggttggttaaactgctagccctagcaacataagactcattttaattacaatatggtattattaccaaggatgacttacatctgtcccttaggtagaaaaagggaacccaagtgaataaccattgacgatctctgttctttgagaatgagtttttagcacattgtgataaatctttgcgagttttgtcagtttttgactcttgcttgaccgtgtatcctagaatgagtcactggccgcctctgcctcttgaattttgttaactacattgcaggaaggaaagctagaaagataaatattatccgatagtggaggccatctaaatattagagcacagcctctctgtctttaaaaaggtgccagatacttggctctaaattgactagatcttgatcacattaattcaggcaaagctgttttccttagatcattgaggaggcgaaacgatcccttcacgatgctttgtgtgtcatccggaacctcatccgcgataatcgtgtggtgtatggaggaggggctgctgagatatcctgtgccctggcagttagccaagaggcggataaggtaagggatctgtgcagacttagtgaaagattcaggcctcgctgatggtggagactgtgaagctgcggaacagcgaggtgctggatgcaaaacaagcatcgtgagctgtgtgtaggtgacaggtgttttaatctaagttaattcccacgttcctgtattcagattctggttaccataacctagcatttctcagctgttttcagccagttcgtccttgaaataataaatctatagtcttttaatgttatttgaaattcaaaattaatattataacttaaaaataaagccataagagctgctgtattttgagacatctctcacatgtatgtataccctctgcctgtattctgtggtgacattataatattctgatagatacaaaaataaagacagcctgttcttacaattctttgtgagctgacttttcaaagtatgtgatacagttgtgttttcacggtgccgctgggttgttttgtttcgccaagtgcactcaccatacttctgtacctttccagtgccccaccttagaacagtatgccatgagagcgtttgccgacgcactggaggtcatccccatggccctctctgaaaacagtggcatgaatcccatccagactatgaccgaagtccgagccagacaggtgaaggagatgaaccctgctcttggcatcgactgtttgcacaaggggacaaatggtgaggagctgtcacgcctctgcgtggagggggggggatgtctgatttaaactgaataatcatccactgtatgtgctgtgagatgatggtgtctttttaaatatgtaagcccacttcaggtgttcaagtcctgaattttagaatgtttgattgccgtaggaattggttagactactagacctagcaacatgagactcattgtaataacagtaaagtgcatatggtactatcaccaaagatgacttaggttttaatctctggtttttgggaagtaatgccttattgctgtttttacacagatgtctgtcagtgggcagcatatatataacagctctgaagtgggctttagttcacagttcactgtgtggttaatcctgcacactgtggagtgttttctaaatgtaatatataacctctgtagccacttgtgtagctcggctcccaaaaagatatggtggctgtagcttgttgaaacagtggtctcaggcatttctgtactaaatcaggccatgtctgtaatccatccacagaatgacagcttttgcttaaaggtataggtacattctgctttccatgctcaaattccaagggtttcaatagtagcaactctttgtgaggcaaacatttaatgtttctaacttgaatgcctggttgtgctcaaatttagcatttctagggccgggcgcagtgactcatgtctgtaatcccagcactttaggaggccaagccgggtggatcacctgaggtcaggagtttgacaccagcctgaccaacatggtgaaacaccatctctacaaaaaatacaaaattagccaggcctggtcagggcaggcacctgtaatcccagctactcgggaggctgaggcaggagaatcgcttgaacccgggacgcagaggttccagtgagctgagatcgcactgttgtattccagcctgggtgacacctgtctccaaaaaaaaaattagcatttctagatctttcttggaaatatcttacatttcagctgtggtcagatggacttactttagatttcctaagttagggtatggatactttgtgggataagatgttcctgaaaaatgtcaccctgtagctagtcattgaagacagtgccctcccaacagctctctttaccaggtgcgagttccagagtgtccttggaagtaatgaaattacattcatctgaaaatgaaatataactgaaattagtggcttcctgcttggcttccaggagtttgtatttcttaagtcttactgtgattccctaaatcagaaagagttggttattgatagtttattgtatgctattttaggataatcagtgtccttgtatttttcagatatgaagcaacagcatgtcatagaaaccttgattggcaaaaagcaacagatatctcttgcaacacaaatggttagaatgattttgaagattgatgacattcgtaagcctggagaatctgaagaatgaagacattgagaaaactatgtagcaagatccacttctgtgattaagtaaatggatgtctcgtgatgcatctacagttatttattgttacatccttttccagacactgtagatgctataataaaaatagctgtttggtaaccatagtttcacttgttcaaagctgtgtaatcgtgggggtaccatctcaactgcttttgtattcattgtattaaaagaatctgtttaaacaacctttatcttctcttcgggtttaagaaacgtttattgtaacagtaattaaatgctgccttaattgaaggggtttgggtggatttttttttctcaaaataagctgtagggactattttaacagcttaaacaggagctctcaagatgcactttcatattgagaggaatatgggcttgatcctcttcctatctaaatgggtgggccatttgattgtagagggtccaccacagaattatgggatgccttaagtgctgttactaggttgctcacagcctaacctggcgtgttgtttagggctgatggagacccatgtgagcctttgctttcctctggccccggccccaccctgaacacagctcatacacagaatcaggaccagcatgtgcagagctggccaccagcacaggcttagggcagttcagaacccacttgtttccctatcagagggacacagtgaagtggaggttaaagtaaattacaggaaataagggagaaatcttgcagttaccatgttcagatagagtgactgaaattaattgtacttactaaagtattaactagctaacagtgatgggccaagacgctccgagaactctaccgggattgtctgttctgacaacccagtgaggcagatacactttcttactgctcacatcttacaggtgagtactcataattggccagcatctcaccaccagcaagtagtagggccaggtcaatcccaggcagtctgaccccagagtggcccagctcatcccctactctgttatttgcttgttaatgattctctagattttctaaaataatgtttcttagcattgtgatgataaagctcatgatgaactttatcactagttatgccaccttaactagtcagatttcctagaattaggaaatggtgactcttgtctaaatttggttaagtgatgaatttgggttaccgtctcatgtgaacctggagattcaccagtcttaacttttgggtcattgtgttttctctacattcatgcattggatgttttgctaaataactcctgtggatttaggaatgtgtgctaatagcaatcttcctaattttcatgtttatatggaactatgcagttgagtattgaaagctttaaactgagtttatttacaaggactgagtctagcctacagagaacatacagcagccttctttggaccacagtcttatccgaggggtctgtggttgtatcagaagagccactaaaccaatccccctttccaaaattgaacctcacagacgttcctgttttttgtgattgagaaactggtcaatgaacaggaagacttagagatgtttcacaagcctttgatttttgtttcatttatttgtaataaacctcttccacgtgatgtcttttatttttcacgttccagatcactcaagttttattttgctggtactttggccacaccctctccttccccatgtggagcaaaagcaacttagggtgcttgacccaaaggctagattcccatgtaagtccccatgtattactgctggttcccgatttctacacctgctagattcattggaggtttgttaaatgtcctgtttttaatttcagcctactcaatttctatgtgggggcagttccaggatgtcctgtaggtgccagatttcatggacgctcaagtccctgataaaaatcgtggtatttgcatataacatacatcctcctgtatactttaaatcatctctattattcataatatctaatataaatgatatgtaagtgtcatactgtatttagggagtaatgacaagaaaaaatctacatgttcagtacagatgcaatttttttctctgaatgttctcaacctgaggttggttgaattcagatgagggtcaactctgcaagcagccgctgtgaggcacaaatgtcacagggagggctaagaggcccatctctctgttacattggactgaatttcttgactctcattttctttctctaggtgaaacagctccaacagattgagggttggggggtgtggccagaggaaggtgacacggtagtaactgactaatcagtaatttgtaagcatggagaagtttctccaacctaggtgttccttgcaggcagtcttggcagaatggggtcatctaaaagcaccagaaaagtggggaccaaaggcaaatggccgagaaagtgttgaagggcaggaaaagtggggaaaacacgacaaggtagtaaaaatataaatgtgtgtgccctatcactgctctaaatggtttatgtacattaaaactggttttcaaagtctgctccatggatccctcggggtcctgggtctttccaaggggcctatgagtcaaatgtattttcctacactgaagttactgcccttttcactgtgttgacttttgcactgatggtgcaaaagcagtgaccattaaaaccacaccttagtgtgagtcaggtagtggcaccatacactttcaaaaagaaaatcatctttttggccaggtgcagtggctcgcacctgtaatcccagcactttgggaggctgaggcaagaggagtcgctctagcccaggagtcagagaccagcctgggcaacatacaccctgtctctaccaaaaataagttagttgggcctgatggcatgcttatatggtcccagctacttgggaggctgaagtgggaagatccttttgagcccaggaggttgagggtgcagtgagccatggtcacaccactgcaatccagcctggatgacagagcgagactctttctcaataataaagtatgaatctttgacattgcataatgaaatgtgtcaacaaccggaagatctgctcactagaccaatatttgccaaatatgcatatgatgttacagcatcatgcataggtaccagaccttttcaagatgcaagatggaccagtgtgacagaagaaagtgtattcagtctatcacttgttgggttttggtgcaatatcgaagaatatccagttttgtgaaaggcaattaaaatacttctcccttgtccaactacatatctgtgtgtggccagatcttcatattccagaacatgctgtggccagacacagtggttcatgcctgtaacccaagcactttgggaggctgaggcaggagtatcgcttgagcctaggagttcgagaccagcctgggcaacaaagtgagactctgtctctacacaaaaaaaattgtttaattagcagggcatggtgatgtgtgcctgcagtcttacctacttgggaagctgagaaaggaggatccctcgagcccagggggttaagctgcagtgagccatgaccatgctgttactggcgttgaatctgcacaggtctgcaacagcctcaattctcgcctcctcagaagaaagaattcggctgaggggcataacgcaggagagaccaaggcaagttttagagcaggagtgaaagtttgttagaaagctttaggccaggcgcggtggctcacgcctgtaatcctagcactttgggaggccaaggtgggcagatcacttgaggtcagaagtttgaaaccagcctggccaacgtggtgaaaccccgtctctactaaaaacacaaaaacattagccgggcatagtggcaggagcctgtaaccccagctactcaggaggctgaggcaagagaatcgcttgaaccagggaggcggaggttgcagtgagccgagatcacgtcactacaccccagcctgggtgacacagcaagactccgtctcaaaaaccaaaaataaaaacaaaaagctttagagcaggaatgaaagaaaagtacacttggaagagggccaagcgggcaacgagagatccaatgcagggttgggcctttcaacttggggttttatatgttggcgtacttccagggtcttgggttacttctcccgattacaccccaggcatgggctgtcgcatacacagtggcctgccagcacttgggagaggagcagggcagtgtgtttactggagttctacacatgctcacttgaggccttcttcccttaccagtctagcattccagttagatgacgccattttgcctcttaatgcgcatgcttgagcccacctgtccaactcctgagatgttgtcaggaagctgctcatcaccagtttcaggtgttttctatctattgggagactgcccttcccaggcaccggctgtgaccaattgttattttagggagacagttaacaaccgcctgaccatcacctgagggtcagctggcatcacctgagggggcaaagggttaggggccactctttctgccctgctcatgcctgactagctacctactgttaacagtgtcactgcattccagcctggtcaacagggtgagaccctgactcaaaaaaaaaaaaagtgtaaaagaatcctaaaaccaaaacatttgatcctcatcataatcctagtcattgacaagtccaagagacactgcataatttgaatggaccactcccttatggaaataaactttttaactttatatagttttcagtataagcagctgaaaatgtgcacttagcaggatgtcttatttatcacatgatcttgacgcctactgcaaagacgcaactgaagccagcagtgtggtctttcagctcctcggctcccacttcgtttgcagcagttcatcgtccctcacctcctgtgagaggcagaattctaaacctgtgctcccaagagcccatctggttattccttcaggcactgatctagatactgtgagaagggacttcacggatttcattaaggttaccaatcagctgaccttaaaagagggcaattatccaggtggttccaatgcagtcacacaagcccacaggggctcacagataaaggtgaaagatacagcaggagactcaagagatggcggccttggcaaggtgcgggcgcccacacctgtaatcccagcacttaggaaggccgaggcaagttgatcacctgaggacaggagttcaagaccagcctggccaacatggcaaaaccctggctctactcaaaatgcaaaaattatccgggcatggtggcaagtgcctgtaatcccagttactcagaggctgaggcaggagcatcacttgaaccctggaggcggaggttgctgtgagctgagatcacaccactgcctgggtgacagagggagactctgtctcaaaaaaaaaaaaaaaaaaaaaagaacaccctgaggattccacatgccattgctggctctgagatacagggaccatgtgcaaggactggaagctctgggaactaagtgtggcctccagctgacagccagagagaaaacaggaaccctgatactacagtcgcaagaaactgaattctgccaaaaactcaaatacacttggaagaggctttttcccagagcctcctgacaggaacccagtgaaccaacaccttaattttggccttgtgaatcccacagcagagcaaccagccaaggcttctgatctacataactgtaaagatataaatttgtgtggtttaagttgctatgtttgtgaaaatttgtcacagcagcaatcggaaacgcatatgcttctgtcttgcctcagtgggggaggggagagggaagggtatcttcctcctgcccgagacaattccaatgtcccattgattccatctctcagagcttgtttctcatttctgcatctgagattgtctttagtgctcctcaggatgcgttctggacttatagtaggattgcactgcccagattccttgtggttggatggggttctgtgactagtgagggtctcagaatacaacaccccaaaatgaaggcttcagaagcagctctctctgacctccttccctcctgtttctggcccttcattctgccctgaagctgaaaaccagaatccctcttcccctaggtggtcatagaaaccagaacctctttccctcaaagccagccacaaaacctaaaactattactctaaaaccaccccctgttgccacttccctgtaaaaactggccataaagaaattatctgacctatcttgtttgcccgtaattcataagacccccattccagagagggtcctgtctgataaccagaaggaagaaatgctgccctgagaggccaagaagagtctcaccaggccttgctggggcccccactcagtccactggcattagatcagaccctttttctccaaccgtatttccacgtgctgcccacactttgttgaacctaagcaaaaaaatggacagttttgtggctcatgactgtaattccagcactttgggaggctgaggtgggaggatcactggagcccaggaactccagccaatctgggtaacatagtgagagttcatctctacaaaaaacttaaccgggtgtggtggcacgcacttgcagtcccagcaacttgaaaggctgaggctggaggattgcttgagtccaggagttggaggctgcagtgagccatgatcacaccaccgcactgcagcctgggtgacaaagcgagaccctgtctctaaaacaaccaatcagtaaaggacaatttcccctgtgtctttgggtcatcgttctgatggctcccatgtcacataaaactatgatcaaataaatttgtatgccttttttcctattaatctgcctcttgtcagtgactttcagagggtgatacggaagttttcccttaacccctacgctagtacagtccagcgtctgtggcagcagtatgatttccaggttagagcatgtacatgccaaggcaagacccttcaaggctcactcttctgagcacacagcacagtgcactattcaaggcagtggctgccccatccgctgaggctccccagaggtgaagatgatgtaagtcctctggcaacacgcaagggacatggaacatggtaagaatccagctctttgctggtttagaccctgagaataggctcctcctgtctgtaaatctctcttacctacacacacagcctcccctcctctgttagcactttccagcatgaatctcaccttaaaaagcaaaaaccagccgggtgcagtggctcacacctgtaatcctaccactttgagagactgaggcaggaggatcacttgagttcaggagttcgataccagcctgggcaacacagtgtgactctgtctcttaaaaaaaaaaaaaaaaaaaaaaaaaaaagccaggtgtggtggtatgtacctgtagtccctgctactcaggaggctgaggagggaggtttgcttgggcctgggagacagaggttgcagtgagtggtgattggaataccgcactccagcctgggcaacacagccagatcctgtctcaacaaaaaaaaaaaaaagaaaaaaaaccaaagcataggaaaacaaaacccttcaattgtgtcccctggagccatctcttcctgttcactccgttactctgcagcactgttgtcagccccgcttcctctcctgccttccaccttctgctccctccacccacagcgatggtctgtggaccccaccctgcatagaaaccactcgtgctgcaatcactgtgtccttctgctgcaaatccctggggtgctctctgagttggagtcctctttctcacacacacaaccttttcctgtcttttttttaaaaaaattctcttcctttgtgaagctcctctggtgactttcctggagctctgccctctagttgctcctacatccctggctgctccccacctctggccgtccccctctgcggttgccacttaatatgcattcagggagaactaccctgggtccaccagcatttactcaagggtgaggcatgctgatgacacttcacctactgttaccagtgtgaatctgaagggtctacatcaaatcaaatccttgcctcctcgaatgaaagaattcagctgcgggtcgtaaggcagagggacagactgaggcaagttttaaaggaggagtgagagtttatcaaaaagttttagagcaagaacgaaaggaagcaaagtacacttggaagagggccaagtgccctgtttggtctgtgacttggggttttatacgctggcatggttccgaggtttgcatttcttttcccttccaagggaaaactcccaccaagtctctcccatgacacgtggggattatgggaactacaattcaagatgagatttgagtgaggacacagccaaaccacatcagtcaggctcacatctctgcttcctgttactgtgctccttccctctccagaggggccgaactttaatctttctaaaatgcaaataccattgataagttctgctgctctcatctaaaggcctgaaaagcacatccccaccttgggactcagaggggccagccctaccgggactggctgcccttttacagaagaaggggtggggtgatcctgaggccgcaggcatccttcttgcttggtcttctagaacaggaatgcactgagtttgcaggttgctggcgccccaggactgataagactgcccacgttggccaggcattgggataactcttcccttggagcaggctgtccaccatcttgcctcttagggtgcatgcttgggtctgcttgcccaaatcctgagatcttatcaggaagctactgatcaccagcttcagatgtttctctctatagggagactgcctttccctggtgctggctgtgaccaagtattattttagagagacagtttaacaaccacctgaccatcgcctgatggccacctgacattcctggggaggtagacctctcctgccctgcttatgtcttcctgactacctactctaacaatgcacccctgcagagttatgttattttactgagtttatagcttttacattgagaaaaactgagggtcagagaagcacattgcccaaacccacaagctaaacatgaagcatggatacacccagcttttccctcctgagcctcctcttctcaccctcgtcttcctcacactctccctctgccatacccgccacagccacctcatggatgactcccaacgttacagagccacatgggtctcatacaactgccccccacaaccagcctccacactcctcttcatagcccaccaaagcccagctctgtccagagggagcgcaccccatccctggctaagtgagtcagggtctaatccaatcccgtcaccaattccccttcagctgatgcccaggtcctcggcctctcccatgacacagggggcacacagctgggggatttccctccctctctaaaacagaggtgcaggagagagctccttccttcccttcctgttgtggctgggatttgtaaggccctagggcccagagaatgcagacaccaacccgggtcctgacaccaggaaacccccaaaccacctgagatccctggaggactgtgtgggagatacttaaatgttaccctcttagccactgtcagtcaggttttctgttatttgcagcccaagaaaactcaactgatattccaggctgaaccaaacttaaattgtttcctcacagcccgcttctcttcaggattctgtgctggataatttgtgctggataatctctaagccaacctcagggtcttgcttcttggtgtcctctcagtctctgcagtaaaagcagttgcatctctcagcaactctccactctgctgcctcggtcagtgtattagtctgttctcacgctgctactaaagacatacctgagacttggtaatttataaagaaaagaagtttaattgactcacagttcagcatggctggggaggcctcaggaaacttacagtcatggtggaaagggaagcaggcacatccttcttcacatggcagcagcaaggagacatacagtgcgaagtgggaggaaagcccctcatgaaaccatcagatcttgtgagaactcactcactttcatgagaacagaagggaggtaactgcccctatgatacaattacctcccaccaagtccctcccatgacacgtagggattatgggaactacaattcaagatgagatttgagtgaggacacagccaaaccacatcagtcaggctcacatctctgcttcctgttactgtgctccttccctctccagaggggccgaactttaatctttctaaaatgcaaataccattgataagttctgctgctctcatctaaaggcctgaaaagcacatccccaccttgggactcagaggggccagccctaccgggactggctgcccttttacagaagaaggggtggggtgatcctgaggccgcaggcatccttcttgcttggtcttctagaacaggaatgcactgagtttgcaggttgctggcgccccaggactgataagactgcccacgttggccaggcattgggataaaaacagccccaatctggaactcaaggagaattaaggtctcacctgatggagggagctgcctgtagggcccaggcctgcatgggagggaaaagaaatggcctttttggtgtctgcagacatggagaggggctaagcggaggcacagatctaggcttgaggagtttgccaagtaaataaatgatctggctgtaattgagaaaaaccatgttaaccaaaaagcgaccaaggcagctgtcaatccacagaggtttatttcgccaaggttgagaacgagcccacgaaaacaaccacaagccacagaaacatctgtgagctgtgctttttccaaagggggtctggggcacggcaatatttaaaaaggcaagggcaagcaggagggaaaagacgggggagggacgcagtgaggcagatggtcgcattcttgtgaggctctgagtctcagtaaatctacattttacacgtgaagaaaggaagcacaggaaaagtcaattatgcatttgtctcagggatgatttctggtcttgtctttgtcctctctgtgaggatcacctggtaattgacatcgtcagggtgagatccaaaaaacttgtttcagggctagtttatagggggtggatatagcctgaaagatctagctgctcacaaggaatttctgtgtgagcgctttgggagggaggccatctggggagatgtgtggccttccatggttgtgggatcctggcttacggacgaggctctaacacagggttgtgacattgcagctgtctgtttgggaaggaaaggaaggcagtattgcgcagttcccaagctgaactttccctctggcatagtgactttcgggtcctgagcgtctattttctttcacaaccagctgcagggctgccataaggcggacaaacaggattaatggaaagtcaacaggatgcagttggggatgcgaatcttcctcgccagtatagacttgcaggtgtggccagtgactaccctgctacagggttagcactcctggggaggtcaacttttcatttcattttaattcacttaaattaaaaaactgaagcagtgtaaaatacttctcctgggctgggcgcggtggctcatgcctgtaatcccagcacttggggaggccgaggtgggcggatcacttgaggtccacttgagaccagcctggccaacatggtgaaaccctgtctttactcaaaatagaaaaattagctgggcgtggtggtgggcgcctgtaatcccagctactccggaggctgaggcagaagaatcacttgaacccgggaggcggaggttgtagtgagccaagatagcaccactgcactccagcctgagcgacagagcaagactctgtctcaaaacaaacaaacaaacaaaaaacttctcctgaaaaaacgacaagaaaaaatattgtggaaagctctgttgatcccaccacactcggatctctgttcagtgtgtgctagaccctctgacctcgatgctgtcagcactgagatgacagtgacacaaaagccagtaaattcacttaatttagattgacgtcattttgaaacggatacgcttttgcttcaaagtcaaatcaattgttctaaaacaaatgaagcagttttgtcaatgtgggaggtgaactgtaaaggaaatgacttttgatgctagactcagttatcggaaaacttaaatatgtaaatctacttttctcaactgtaaattttgtgaaatctaaacataaatcaagtacttttttttgttttttttttttttgagatggtcttgctctgtggcccaggctggagtaaaatggcaccatctcagctcactgcaacctccacctccgggtttaagtgattctcctgcctcagcttcccaagtagctgggattacaggtgcccaccaccatgcctagctaatttttgaatttttagtggagatggggtttcaccatgttggccaggctgatcttgaacttctgacctcaaatgatcagtccacctcagactcccaaagtgctgggattacaggcatgagccactgtgcctggccaaatcaagtacttctgatgaaaagttagcatccaaatggagatatgtgtaagcagaaaatacacaccagatgtcaaagatagaggaacaaaaaaaaaaaaatacaaaatatctcactcatgattcgttacattgattacacactgatggaacatttgtgataaattgggctaaaatgcattattaaaattaatttcacttgtgtctctttcctttttttaatggggctataagaaaatttaaaattacatacatggggaaaaaagctaaagttgccattttttccctttaccttcatttatctgtttgtctaatagtcactgaagaacatatctttttaaagaagtacgtgtgtgacttacattatacttctatctgcagtgctggttcagaacaccatgacatttgaccaaaggactcagcagagggaaggctgcccaggccccaagctcaccatgaaggatacagccacacccttggttcattctcgcacgaatttcagacctcccacctatgttgaagactctggctactggccacatgctcaccgacaccgttccacggcaaaagcccagcacatctcaggggtttcctgggaggccggatgaatgtgtgaggcctcctgggagcagccctcagcaggcaagggctttggcctgttggggtccacaactaagtgtccacagtagaccagccctgctcaggcttggattctctcaacattaggcaaagggtctccccatacccatttgacagatgcaaaaactgaggctcaggaagctcaagtttgggaattctttgaattttatgtttcctgagcatctatttgaatgtaagttggactttctcatactagaagcagggattagtaacacagtttccagttatacaacttctcactgttccccaaggtggtcgatccagacatctgccttacaaaaccgcctcctgggaccaccttcccatggacagctggataccacctgcttgacttgtcccactgacccccacacccacatggaccatgccgatatcctacccacaccgacccctctcagtcacagcgtgagtccccggggctcatgcctgcttgctctaaaccccccagttagaacctccaggggaaacctgcatagatgacaccctgggccccagtgaaggctttggctcatagctccctctctctctcgttctccaccttctggttgagcccatgtgtcctgaatggctccccctttttgctggccctgtgaagcgtgctgccctctgttctctggatctgtaagcaataaactgcttctgtcatttcttgggttctgatgagttgcctcctctaccccatcctaacttctttcccggtcagggctctccgggagagtggctgtctcagtaggaataaactggacacaggtcagatgagagccacaaggtcatgtgccaggataaacaagcttcctgcgagagggacacctggccacaggttggacactcaggaatcaggccgtctgtgaggtcaaagaaggatcccatgaaaggcacatgggaaacacccacgaccacatccccaggatccccgtcagggcagggctagagtttacagccactctctcctgagaaggacgtcaagacaaaattaggaaaaaaactacaacatcaagtcacttgcccaaagtcacatgtacgcaccccgtaggtgcaggtgcagagtttctcaccggctctcccctttacgccaccaccagaaacacaggagatatttctgaggtagcctcaggccctgggacccaaaaatgccagtgcttggaaatccactgcttaggagacaacagctgggtgacaactctagcccaccgttctctgctatctttttaaaaaagctgcaaattcaaaaattcaaaaaattagtttattagcttaatataattaggtcaatggaatcctgttttgatctcaatacttcccatattgcaatatataaatgtgacaaattcagctgttttgtggcatagataagtgtctaagctgggcagttagtctacccgtttatagttcatgttcttcatggctttgcagcatttgtcactttctatgatgtgttcaaagaccagaaaaggccacacttgacctgtcagctggtccttgaacagctgtaggtttttttttttttttgagacagagtctccctctgttgtccaggctggagtgcagtagcgcaacctcgactcactgcaacctctgcctccaggttcaagtgattctcctcctcagactcctgagtagctgggattacaggcacatgccaccatgcccggctgatttttatatttttagtagagatggggtttcaccatgttggccaggctggtcttgaactcctgacctcaagtgatccacccacctcggcctcccaaagtgctgggattacaggcgtgagccaccgcacccggcctgtaggttttaactaataattagggtattactctatcattctctatcattcaaattctccaggtactgacctggtttttattttatttatttatttatttacttatttatttttgagacagggtctcactctgctgcccaggctagagtacagtagtggcacaatcttggctcactgcagtctccacctcctgggttctattgattcttgtgcctcagcctcccaagtagctgggactacaggcgtgcaccaccacaccaggctaatttttgtattttttgtagagatggggtctcaccatgttggccaggctggtctcaaactcctgacctcaggtgatccacccactttggcctcccaaagtgctggaattacaggcatgaggcactacacctggtcagaccttgtttttaaattatgattcgatgtacatgtcaaaaattaaattatttcatgcattacgtcctactgaatttgtgtttcaaatgaaataatcaattttaggattcctacacttattttataaaagtgaaaattaaatcaaatgatctaactatttccaagcaaattttgggatgaaagctattctaggaaggcttgcccttgattcttgctacatgtacttgttcagccactcaattaaattccttctggcctcgtcaatgtagggcttgtctgcaggtgagcaatcttctctcttccgatgcacgaacccatgagtctgcccagaaaatgttttaatttgatattcaactttgcagtgttctttcaacttctgagtcagcaaagatacctggtgtgcaaaagatttcatgattttaaccctttagtgatactttccattctccaaatctttagtgagcgttcataacagaaatttaacatcaatgctttaaatcagaaacaagttccacagttacactgaattctttcccactaatttttttctttttagacagggtctcactctgttgcccaggttggagttcagtggcgccatctcagctcactgcaacctctgcctcccacattcaagtgattctcctgcctcagcctccggagaagccgggatgacaggcacccgccaccatgcccagctaatttttgtatttttagtagagacagggtttcaccatgttgaccaggctagtctcaaactcctgacctcaagtgatctgcctgcctctgcctcccaatgtgttgggattacaggcgtgagccacggcgcccggcctctactgctaattttataactaacacagtccttatgtctggcaaaggagagatttcagggaaatggaaaaatgatacatctattatttgaaatcacttgcattaatatattagttactaatattataacaataatttctaaatgactgcttttttttcttaagagtcagggtctcactctgtcacccaggctggagtgcggtggcacaatcgtggctcactgcagcctccaactcctgtgctcaggcaatcttcctgcctcaggctcccaaatagctgggactacagatgtgtgccaccatcccagctaatttttttatatttttgtggagaagggatctagctagactgcctagcctggtcttaaactctcagcctcaatcaatcctcccacctcagccttctgagtttctggaattacaggcatgagccaccacgcccagctaaatgactgcttttgaaccatacttttcttctgctttttccttatcaactgactttgtttaataaatccttgtctttaaggtcacagactttattgtaatttgtgggttagcatggaggtggggcaagaggtcccgtttctccaccaggtaaccaggccatgctgagaatacttccctcagacatttccttaagcatgttttgggaaggttatacttccacactggaattatataagtggaattgaataaaacccatctttaaaatgttaatgttggaaatatttggagcaacaaatgcatccttcaagacttcccactccccgcagaatgtcaaaccgtgctattaaatatataaatgaggccaggcgtggtggctcacacccataatcccatcactttgggaggccaaggcaggcagatcacctgaagtcaggagttcaagaccagcctggtcaacatggtgaaaccccgtctctactaaaaatacaaaaattacccaggtgcggtggtgggcgcctgtagtcccagctactcgggaggctgaggcacaagaatggcttgaacctgggaggtggaggttgcagtgagccgagatcgcgccactgcattccagcctgggcgacagagcgagactccatctcaaataaataaatacgaagagaaaagatgccaacttacgtccttgagtggaatcacaacatcattttcagcaaaaatgaacaaagtggggttctttaaattgtaaatgtcttcagaatccttgacaatgcctgaaaaacaagcacagaggcatgatgtctgatccccacactcatgccacatgatccccacacccatgccgcatgatccccacactcatgccacagaaaactgcaacatttgggtttgatttttcaaagtaaaatctctgctttgcggactttattttcttttttagccattccacagaagtggccccacttgtaagattagcgtaaaagaaggccgggcgcggtggctcacgcctgtaatcccagcacttcgagaggctgaggcaggtggatggcttgggctcaggagtttgagagcagcctgggtaacatcgcaaaaccctgtctctacaaaaaatacaaacataagccgggtgtggtggtgcatgcctgtagtctcagctacttgcggggactaaggtgggcggattgcttgagcctggaaagttgaggctgcagtgagccgtttgtgccactgcactccagcttgggcaacaaagtgagaccccgtcaaaacaaaacaaacaaacaaaaaacccaaagcctgggcgcagtgactcaagcctgtaatcccagcactttgggaggtcgaggagggcggatcatgaggtcaggagtccgagactagcctggccaacatggtgaaaccctgtctctactaaaaatacaaaaattagctaggtgtggtggcacgcgcctgcaatctcagctactcgggaggctgaggcaggagaatggcttgaacccgggaggtggaggttgcagtgagccaagatcatgccattgcactccagctctgggcaacagagcaagactccgtctcagaaaaaaaaaaaaaaagaggattataagagtacaagagaaatttatttagtcagatcctcctactgtctacctccccactttatggactgggaatcaggccattaaataattgaatgatacctcgtccgctgcttagtatggaaagatgcggagcagcctgaggaatgtcccgctgggatgtaccttcgtttacaaagaggatcaatgtcaaaccttcgcttgagaagtttctcaggtctacacaagtcccacgggttctggcttgaatgcactgagtagttttgttggtaagaggagctgtcttttgagtgggtatttagactcgcaccagaccacgagtgtggaagtgtggaagtgtgaaactgcctgggcctagcaggtcagtctataaaaatcagtttttggccgggcgaggtggctcacacctgtaatcccagcactttgggaggccaaggcggggtggatcacttgaggtcaggagttcgagaccagcctggccacccacgcaaaaccttgtctctactaaaaatacaaaattagctgggtgttgtagccccagctactcaggaggctgagacaggagaattgcttggacccaggaggtggaggttcagtgagccaagatcgtgccactgcactccagcctgggtgacagaacaagatgctgtctcaaaaaataataacaatagttttcatctttcatctcagcattcattcgagattaattctgaaattagaagcatgctctgcctgacccaggttgtctgaaaacaacctgtgggtgtgtccacttctatgcgaaaataagtaagtaaaagatttgcagcaagttaaccattttaagataagaagacgtaaataacataacttttttccacttcctgctggcagcagaagagctaagtaacagagagagcctccttcacctgtaactcctcttcaggaggcagggagccacgggaaaggtgaccacgctcccttccccactctagcaaagctacttcatgtggatgggcctcttttgatatccctgggcctgagcccggccacgctctgcagctcacgcactacacaacagcggccagaaggtggcgccggggaggcatccactcccgaccgccttttgctaaatcgcgcaaaagcatggtctggacaaagcatctctcagctccattgttcccagaggcagctggccactgccttttgagtttatgtccttttgtgttgtcctaagtcaatatttaaaggcgtttttaactctaaaagtagttgaaaataccacaatgaggaaccattaacccaagaaggaatcattagtataactttatgatccacttcagatggtcccaggcctaacgatggttccactttcattttttgactttacaatggtgcacaagcgacactcattcagtagaaactgttccccaagtacccagacaaccattctgtttttcactttcagtacagaattcaataaactgcatgagacattcaagactttattataaaataggccttgcgttagatgattttgcccaactgtagcctgatgcaggtgtttcgggtcggccaggtgaggctatgatgcttggtaggtgaggtggattaaatgcattttcgacttgagatattttccatttatgatgggtttatcaagacttagccccattgtaagtagaggagcatctgcattatttttaaaggctatatttcctatgtgtcttttttgttttcgtttatctattggtctgaatgcttctatatcatgaatttagcaagcagtttctatatacagatataatgttatttcattgctgtagtaactttggtttgttttggccaaaaatgtataaattgctatttcgattttagagtgtgttttccttggctttctttccttttttttttttattttttattttaagagacaaggtctcactccctgtcatccaggttggagtgcagtggtgcattcacagctcactgcagcctcaaacttctgggctcaagtgattctcctgcctcagcctcctgagaggctgggaccacaggcatgtgccagtacacccaagtaatttttttctttttcttttgacagagtctcactctgttgcctgggttggagtgcagtggcacaatcttggttcacagcaacctccacctcccgggttcaagcgattctcctgcctcagcctcctgaatatctgggactacaggcgcccaccaccacgcccagctaatttttgtatttttagtagagacggggtttcaccatattggccaggctggtctcgaactattgacctcatgagccacccacctcggcctcccaaagtgctgggattataggcgtgagccaccacgcccagccttaaaattttttatagagacaaggtctctctatgttgcttaggctggtctcgaactcctgggctcaagccatctgcccatcttggactcccaaagtgctaggattacaggcgtgagtcatcgcatctggctgcctttgctttctttcttagtgtgtgtgcatgtttgtgtacagttagagcaatttgtatcttggaaaaatcagtctttctttctttctttctctttctttttctttttttttttttttgagacagggtcttgctctgtcacccaggctggagtgcagcggcatgatcatggctcactgcagccttgaccttcttgggctcaagcgattttcccacctcagcctccggagtagctaggactacaggtgcacgtgaccacgcccagctaatttttgtattttttgtagagacagggttttgccatgttgtccaggctggtctcgaactcctgagctcaagtgatctgcctgcctaagcctcccaaagtgttgggattacaggcattagccaccaccagaaaaatattttcatagatgttgctcataaaaatcttgtgtgatattgatcatcattacattaaaaaaacaaaaaaagctatccccttcatcctaggtgaagaaatggagaatttagattaggtggctttcccaaagtcacaccactgggacccagacctcttgactcccggtgacatcctctggttaactgcatgacaaacctccacctctattttcagattcttaaaacccatttccataagatgggcagtcttcacattattgggggttgtgttacactggatggggaggcttgtgattgttgtcactcttccacccctcccttctgcatggagtaaaaatgcacaaggcagatttaccatagacggacacccctgccctgaattctgagtatttcatcatcaaatgatggacagcagttccaccccagcagaatcccacgatgccaattttctgggcatgacactgttgtttcagatacttcaagatagcactgatctctctagaacagaaagaaaaaatattcaagaatcaggcttattttgtgaacccctcaaagagctgtgctgatgataacagggctgtatcagcaactgtttttgaagttgccaaggtttcttcttttgggagctccacccttactacctctggcccaactgatgcatcatcccagcacatcttcctgccaagcccagccctcctccaactgcctgacagctgcaggcaagctgggctcttcccaaaacataggtccaactgcctcactcccagctgagagctgagcagtcttccacagcctggggatgaaggccacagcccacagcacggttcgtaagacccgagtccatgatctgctccctgcagagtgccccagtcttctctgtcccctgagtctcccaggagaagagtctcctctctcctctctcccatgagcagccataactatgggcagacgcccagacactctctgacttcacacgttcactctctccccaaaactccccactctgcattgctcgtctcctccccctgccgcccagtgaagccaaatttggaacgccatcaggactatttcagccatgaggggaccaagaatagtggcccttgtctggcaaatgattcatgtgcaaactgattgtttggaactcagaatacattttcaactagaagcaatgtaccaaagtggaggtgggctgcacacgtatgtttattgtagcacgattgcaaagatatgcaaccgaagcgcccattgaccaatgagtggataaagaaaatgtggcctatatacaccatagactatactcagccataagaaagaacaaaataatatcttttgcagcaacttggatggagctggaggtcatttctctaagggaagtaactcaggaatggaaaaccaaatactgtatgttctcacttataagtggaagctaagctatgagtagattcacagaggcacatagagtgatataatggactatggagactcagaagggggagggtgggagggtgtgagggccaaaaaactatatattaggtaaactgtacactactcggtgacagatgcactaaaatctctattttcatagatggtgctcataaaaatattgtttgatattgatcatcatcacataaagaatgctatccccgctgggtgcagtggctcacgcctatagtgagaccccatctctattttattttaaaatttttaattaattaatttcttttttttttgagatggagtctcgctctgtcccccaggctggagtgcagtggtgccatcttggctcactgcaatctccgtctcccaggttcaagcaattctcatgcctcagcctcccaagtagctgggactacaggcgtgcgtcatgacacccagctaagtttttggtttgtttgtttgttttttgtatttttagtagaggcaggtttcaccatgttggccaggctggtctcaaactcctgatctcaagtgatcagccagcctcagcctgccaaagtgctgggattacgggtgtgagccaccatgcccggcctaaaaattttaattacaaaaaaaatcccagcacttgagaccagcctggccaacatggtgaaaccccgtctctactaaaaatacaaaaattagccgggctggtggcaggcgcctgtaatcccagctactcgggaggctgaggcaggagaattgcttgaacctgggaagcacaggttgcagtgagccgagatcatgccactgctctccagcctgggctccaacagagcaaaaacaaaaaaaaattttttctcctttgtgccaggggaaggattccattggccatggagaagtcctaccccaaggtaaggagtagtgtctgaaaggtgaagcccacccagctctcacctccctgggccacaacgtgcacatggccacgtctgcggataactcacctatcgatcttctgggcatttcttgttttcagccactcagggaagatagaccagtcgccagaggggtcccaaggctcttgccctacaaagaagtctggaacaatggttctgcaaaatatggacatgaattgatcttagtttcagagttgcttgactcagtattttgcttgcatttatttaaaaacttgctacgttggcgattctggctcagagaaaaggaaaagtagtgggtgtgaaggccaattttgatcgcagcaaagcagccacctggcaccgggccaagccctcttaggtttcacaaccgcaggtgcacagcgtctggcagcctgctggtaacccagccctggcaatgaggctatccacagggcacactcccatgggataggctggcatgggatgtggaggcacctgggggagtgggcctgacgtgggtggctttgagggcccctcctgcccctctcagccagcctggggagactcctggcctttcacatgagcctcaggccagagggcacacctggctaacttgtccagtcactatgaccaggcaatgttcccagcctccaccaagacggcgacgaagcacagtttcctatccagagggtatgttctaagacgggcagcagagcacaaacaagcctggccccagtccaggtcgctcttccatgcaagtcaacccagagggatagagccagccgctggggttgagtcctgtttcccaaaatagaattgccacctggttggaggaacagggctcctcctataggggtagaagaacactgaaactggagtgagaaaatccaagttcgaggctcggtacaccccatgctgctgtgtggccttggccttcacaagtcatgtcaccgcttctagcctcattttctcatctgacaaacttgcactgcctaaccccagaggatcctctcgagggcaaaaaaagttgtatacctgtgaaagggctttgtaaaacaggggtctttccttatcttttatgtcctgacccctgctaaaggaccctccgtgaaacaacagaaacagcaatgccatttgatcggctgcttgggccagtgatctggggcagccgcaaagcgctctctttatggcctggtttcctaatctgcaaaatgagagcaataacagctcctccctcaaggggctgccaggaggactaagggcaatgagcccagtcatgccctcagcactgcgtctggctgagcaactgaaactagctatttatttacttatttatttttactgggcttgcccctagaaagttaagtcccctcacatggggacgtgaaaaaggaaaacttcaaggaaggtcttttcattcagcaccgactctgcatcccaccagggtgggcatgattcctttaagccagtttctcttcctagaaaaacaaggtaggctcatcctcgggtttccagcttctccttctgtgaaaacaaaggaaatccagccgtgcaccatcctcagggctcactgggttgatgctttccgacgctggagaggaaggaaggttctggccctcctctgcgctttacaccggggcaaataagaagcaatcgggtatcagccttggccaaaggtggccatggccacttggccagacaaagaggtaaacttggggaggggagcaaggtctcactgtgccacttctgaaccccagtctaattcagagggggccacgaccgtacgtgtatggaccaggaggagccttggacaccctgccgtccaaatgggccgtgaaatctgacacgaggctgagctgttgaaggaccgagtcacgggtccatttgacagcaggtgaggctggcctcagatgtccagtgcctgcgtctggctgaggccccacacgggaaaagaattctcaatgtccagcaagtctaaaggccaggtactcccaggaggacaggaaacccaggaatggggttaggagcaccaggtgggtgtttaatttcccaagacatttcccatctatcttcacggcagtgagatagggaagtttctaatgtacagtagatactgtatagtcagaccgctgtggttttattttttaaagggaacaaaataaaccactgaaatttgtatgaatttaaacaaagaaacacaactttatacatacgtgtatccatttcctgagatcatgtcagctatatatctggtattgggcaactgccagccaaatatatcttgaatgacaatcacagctttgcctgcatcaacgggggatttggtgacataagccttgatgtgctcgacttgaacttcacggcctagccctccatactcaagtctgtggccaatgtcacacggacaaggataagcttcgttagccattgcagagatttaagtcgggctatggagagagaaacatgcgttatattctgaatgctgcaaatctaaaggctataaatggtaagtaaacctcaaatcaagattatagaaaaaaattcattttagctacatctatggtattatgtgagaaaccaatggtaacttctggttctggcaacactgcagagtaaggctatagacactagaaatgccggattgaataacaacaaaacaacaaaaaatagcgatgaaagaactcacagggaaaagggactcttcagggggcaggatcggagaggaaacagaaagccagagtgagggtgacacccacagatgctgacggggcccagtgatgctgggggacaggacccgactcaggagcacaccctaacagtcgggtgcttaggattttgtgtcgacgtgtagaaagagccatcgaagcacatgagacgggaatttgtaagagacccacgcctgcaatgtcgagccccaaaggttcatgtctcacggaagggggccaaagcaaaaggagaagagctccatccgccaggctcaggtgtgtgcgaagaaacccatctccgtctagattctgagtggaagggaaaaaagaaagcaatcctcggccgggcgcggtggctcacgcctgtaatcccagcactttgggaggccgaggcgggcggatcacgaggtcaggagatcgagaccatcctggctaacacggtgaaaccccgtctctactaaaaaacaaaaaattagccgggcgtggtggtgggcgcctgtagtcccagctactcgggaggctgaggcaggagaatggcgtgaacccgggaggcggagcttgcagtgagccgagatcgcgccactgcactccagcctgggggacagagcgagacgccgtctcaaaaacaaaaaaaaaaagaaaagaaaagaaaaagaaagcaatcctcaaatgtataccatgcttgcaaagtaggaatacctggctgagaaattaacacaattgactctgggccagtgaactgcctggaacaccaggcagaggcaaatgcaaatccactttaccacaagacttccacaatccaggccaaaaatacgacccgctgaagagcagctcatcaggaaaacctatacacaaggaggcgatccaaataaacaagaatcagcagacacaacaccctggaggaatttacagtgggaatggggtttgaaattcacctagaaacacttggtgaatcaaactggaaaacaggaaggaattaggaaattaaaaacctgttcattaaaaagcaggaaatgaggcggcgaaagtgggagtagtagaacaaggaatttgatttgtaaatgactgtgaacaatcaactgagataactcaccgccatcaggcctgcctaaatttaaataaatggaaacagattaaactcactagctgagacagattctcaacttggatttttttttgttttgttttttgagacaggatcttgccccggctggagtgcagtgtcacaaacggctcactgcagcctcgacctcctccctgggctcaactaatcctcccaccttagcctcccaagtagctgggactatggcacacaccaccacaatcagctcctttttttagaataaaaattttatacagacaaggtctcattatattgtccaggttggtctcaaactcctaggctcaagcaatcatcccacctcacactcccaaagtgctaggattacaggtgtgacccatcatgcctggttcaaattagactttttaaaaattaaggttccggaccaggcatggtggctcacgcctgtaatcccagcactttgggaggccaaggcaggtggatcacaagttcaggagctcaagaccagcctggccaatatggtgaaacccccgtctctactaaaaatacaaaagttagccgggtgtggtggcaggcgcctgtagtcccagctacttgggaggctaaggcaggagaatcgctcgaactcgggaggtggaggttgcagtgagccgagattgcgccattgcactccagcctgggcaacaagagcgaggctctgtctcacaaaaaaaaaaaaaaaaaaattaaggttccatcaaaaaagaggaactaggaacactaaacccaaagacatatgtaattcccttcatgaacaactggagaacacagtctttacaagcagatgtgaactgcctgcatattaacccacaatcaaagtttcagtaaagattttatataacaaatgctatacaaatacaacgaagaaattataataaaactcaaaagatttagaactggattaccatgttaccatgaaaacactacatagcaaaacttgatacaatcaatacagcagtaattagagacatctttacagcctagactacatatacttgaacaagaggaaagaataaaagtaagctaaatatcaagaagttagaagaaaaaaatagaatgaagccttagtccattcaggctgttataacaaaatacagtaaactgggtagctcataaatgcagaggtttatttcttacagtcctggaggctgggaagtcgcagttcaagggactggcagatgcaatgttaggtgagggtccactttctggttcatatgtggtgccctctccttgtgtcctcacggggtagaaggaactagctggctctctggggtctccattataaggacattccctatagtaagaggtctgccctcagacctaatcattttccaaagacccgacctcctgataccatcaccttgagggttaggatttcaacatatgttaaaactaaaaaaaagaggtaagaaacaagaatagccacaataactgaaagaaaatgaagaaggagaaattaatttaccaaacaacaaaacctattaaaacagtatggtattgctggatagatgaatacatcaatagaacagaccaaagactctagaaccagactcatgtgtattcatccagtcatccacagaatgtttactgaggcaccactctgtgacaaacactgtcgaaggttctggggaaacagcagagcatgaaacaaataaaaatccctgacctcaggaagcacattctagtgggatgaaatatacaaaaacaatatgcttttcagatggtaatcaatgctaagaagaaaaacagagcagagaaggaaagaagacaatgttggttgagggtgtgagttgcaatttacaatggtgtattggggaacagcttgttggaaaggcaccatttgggcaaaggaggcgaggggtggtgccctgcagatatctggaggaagagcggttgagacagaacaaacagcaagtgcaaaggccctgaggtagaagcatgtctgacatgtctgaggaacagcaagaccagtgtggctgcaacagaaagagcaaggggagagaacagcagagaatagtgtgagttcccagagttttactggaagaatttagtttttcctcagtgtgagatagaagccactggagaattttggggaaatgagtggctttatttgacttgatttacagtatcattggcctgacacagtggctcatgcctgtaatctcaatactttgggaggctgaggtgggaggattgtttgagaccagcctggacaacacagcaagaccccatatctgcaaaaaaaaattcaaaacttaactgggcatggtggcacatgcctgtattcccagctactcaggaggctgaggtagggggatcccttgagcctgggaggtcgaggctgcagtgagtcatgactatgccatggcactccagcctggatgacacagagagatcctgtctcaaaaaaaaaaaaaggatcattgaagatgctgttttaagaagaaatcatcaagtagcaaaggaagaaaagaaagtccagttggatggctccagcaacaatccagccaagagatgaagcagctcacaccaggacggtgatggtgagagggcgggaatggtcaagtgtggacagattttacggcagagccactcagttctgctgacagattgtatctgtggggacatcagacaaaaggaggagtccgtgatgactacaagggttcctgcctaagaaactggaggatggagtgtgtttaaatgagaagggatgtgggaagagctggtttgaggagataaggacttcagtttggggcatattaaggctgaggtatctattacacatcccagagaaaagctgggtaacacgatagaagttcaagggccaggggcccaagctaaaacgaaaactttgagagtgatgtgagtatacagctgaccctcattgtttgcagatcctgtattgatgaattcatctacttgctgatttttttttttttttgagacagagactcgctctggttgcccaggctggagcgtagtggcatgatcttggctcactgcaacctccaccttctgggttcaagcgattctcctgcctcagcctccctaatagctaggattacaggtgcccgccaccatgcctggttaatttttgtatttttaatagagacggggtttcaccatgttggccaggctggtctcaaactcctgacctcgggtgatcccgcccaccttggcctcccaaagtgctgggattacagatgtgagccactgtgcctggccatacctgctgaatgtattttgtaacctcaccgtcattcatggacattcgaaaaatgtgaactgtcaatgtccacattcccagctgaggacacacagggtgcaatagactgaatgtgtccccaaaaagtcagatgttgaaaccctaattccagtggaatgatatttggaggtagggtctttggaaggcaagtagttcacaagtgcagagccctcaagaatgggatgagtgccttatataaggggcccagagagctggcttcccttctttctgctgggtgagaacacagccagaagatgaccatctgcaaaccagaaacaggccctcagcagacattggatctgccagcgcctcgatcttggactttccagcctccagaactgtgagaaatgtttgttgttgaagccacgtttgttagagcagcccaactgcccacaacactctgcttctcatttgagctctcacagtgtaaacaagtgtcctttgcatggtcttagtgcacatttttgtgctttttgaggggttgattttgctgtttaaaagggccccgcacttagtgctcacatgctatctagcattgctaagcacgggaaggctgtgatgtgccttatggagaaaatgcgagtattggagaagctttgttcaggcacgagttacagtcctgttggccatgagcttcctgttaatgagtcaacaatatatattagaatggtatcttccacaaaaacacacataaaaccagggttatgtatgggtcaactgaggaaaccgctgtgaccaggccacaggtttacaggaagctaaccttgtattttccccaggaggaatggtttaggatttgctaactcagtgtttgtagggactttactactacaaataccaagaatgactgtatgtgggtttggtttgtttgtttgagacacagtctcactctgtcccctaggctggagtgcagtggcacaatctcggctcactacaacctccacctaccagtttcaagcaattctcctgcctcagcctcccaagtagctggtactacaggcgagcaccaccatacctggctaatttttgtatttttggtagagatgggttttcaccatgttggccaggctggtctcaaactcctgacctcaggtgatccactgtgccgggcctgtaggtgatatttaaactttaagaatgaatgacatccttcagggaataatggtggatgaagaaaagagaaatctagaagactgagccctggggtccttcaacactaacacttcagggagatgggaaggaatcagcgagtgaggaatgagcctgagaaggaacagccagtgacgggggaggaagaccccaagtgtggtgtcctggacccaagtgaagaatgggtgttgaggggagaacaatgaatgctgagtgttgccctccgcgtttggcaaagtgaaggtcattggtgacctccacaaggacaggcttggacgagggcatgggtgacagcataatcatagtgggcttaaaagaaactgagaggagactgggcgcggtggctcacgcctgtaatcccagcactttaagaggccaaagtgggtgggttgcttgaggcctggagttcaaaaccagcctggccaacatggtaaaaacccgtctctactaaaaatacaaaaattagccaggcgtggtggcacatgcctataatcccagctacttgggacgctgaggcaggagaactgcttgaacctgggaagcggaggttgcagtgaaccgagatcacgccattgcactgcagcctaggcaatagagtgagactccatctcaaaaaaaaaaaagagagagagagagagaatgagagaggagagaactaaagagagtgaacacagaaaactcttagaagacttttgacagaaaaaggagcaaagaggccgggcgtggtggctcacacctgtaatcccagcactttgggagacggaggcaggtggatcacttgaggtcaggagttcgacaccagcctgaccaacatggggaaaccccgtctctactaaaaatacaaaaattagccaggcagggtggtggatgcctattatcccagatacttgggaggctgaggcaggagaatcgcttgaaccgggaagcagaggttagagtgagctgagatcgcaccatttcactccagcccggacaagaagatcgaaactctatctcaaaaaaaaaaaaaaaaaagagcaaagagactgtgcaaaagatggagggaagacacagggatgagccttttttttttaaagtggaagaaatctcagcctatttgtacgtggatgagaatgataccatagaaaggaaaacaaacaaaacacaatcaatgaccccgggagagagggaactggagagtgtgacaggagggtctggcgcatagcagaggagctgccttctttggcagcgtggacagtcctcacgcacccaagggaggctgaggacgtggacacagacacaggtggtggtgggtgtggggcgggagagtgtggatgctccctgttggcatctgtttgctcacagaactgagaagcagagtcagcagctcagggtgagaggcgggacgagggctggggagaggataagcaggaaaacaggggaccagcgagaagtacgtatggctgtttcctccagccaggtccagcagtgggaacaggcgaagagcaggcgcagagcaggcagagagagggggtcagatacaatgggctctgtagtcatgagagggggcaggagggacctgtggggggaggagggactggccatcaatggggcacggctgcagcactgagctacccaggtaagaaaacaaatcaccatggatccccacataccccagtgcgtggctagaaatctaagtaggaaaggcgaaatttcaacaatcagaaggaaatactgaatacttttttcttgtactttggaataaggcagaatttcttaaatttgacccaaaaaacataaaccataaagaaaaggattataaatcccatttcatggtaaccaatttaaaaaaaaaggaaagacaactgcagaaaactgaatactaagtggatatttgatgaaattgcaaattattgtgaattttggcaggggaagatgatggcattgcagccatgtgtttttgagtccttgtctttcatagatgcatcatgatatcatgatgtacccacagatgacatgaccagaggtctgggatttacttcagaatagccccatttgggctgagtgcggtggctcacacctgtaatcccagcactctgggaggccaaggctggtggatcacctgaggtcaggagttcgagagcagcctggccaacatggcaaaaccccgtttctactaaaaatacaaaaattagccaggcatggtggtgagcgcctgtaatcccagctactccggaggctgaggcatgagaatcactggaatccaggaggcaaaggctgcagtcagacgagatcgcgccactgcactccagcctgggcgacagagcaagactccatctcaaaaaacaaacaaacaaaaacccaaaatagctccatgtggggtagggtggacaaggtgtccacgtgctgatggtggtgcagctggagtgtcctgtgtactaatctctctacttttatatatgcttgagattttccatgacaaaaagctcttaaaattgcattaataagatagtaactaagatgaaagattaataagataatgattaacattaatatcaagataaaagtctccataaacaaagtgagaaaacaagatagactaggagaaggtattattttaggaacagaggacttagtgtctagataaaatatataaagaattcttataagtcaccaagaaaaagacaacccaatagaaaaattcatatgaatgggcaatttacaaaaaagtacacctgaatggcccataaacatatgaacagatattcaacctcactgttcttaaggaaactataataaaaacaagaatgaaatactattttccatcttgcagattggcaaaagtctgttaacacagagatgatggtacacttgtagggaaatgggagggcatgtgaaatgatacaaaccctggaaggagtctagcaaagttaaagaagcagatgccccgcaccctagatatcccaccactagatgtttccctagagaaattcatgtcacatgtggtgggacatggtggctcatgcctgtaatcccagcactttgggaggccaaggccggggggatcatttgagcccaggagttcgagaccatcctgggcaacatggtaaaaccccatctctccaaaaaaaaaaaaaagcagaaaaattagccaggcatggtggtgtgtgcacctgtggtcccagctactcaggaggctgaggtggaaggattgcttgagcccaggaggtcaagactgcaccactgcactccaggcttggtgttaagagtgagaccctatctaaaaaaaagagagagagagagagaaatttgcacatgcccacacaggcacatgcagtgattatggaaaaatgttcttggcaccactaatatgatgacaacacctggaaccaatctaattgaccatcaacaggagaatgaataaactgtaatttattgattgatgtaggttgaattgtattcccccaaaatacatgtttaagtcctatcccccactccccgtgcatgtgaccttaactagacacagggtccttgcagatgtcctgtagttaagatgaggtcatactggagtacagtagaccataaatccaatgactggtgtccttctaaggaggggaaaacgtggacaaagacacaacagacgcacagaagagaaggccgtgtgaagatggaggtggagatgggaaggatgcacctgcaagccaaggattgctggccccccaccagacgctggaataggcaaggaagggctctcctttacaggtttcagaaagagcagagccctgctgacactttcaatttggactcctggcctccagaactatgaggcactgtgttgctttaagtcacccagtatctggtaatgttatggcagccctagaaaacaaatacattcataaaaagaatattacacaacagttcgatgaacaggctgcacctgtaatttatcaatataataaatctccagacccgcatggtggctcaggcctgtaatcccagcactttgagaggtcgaggcatggtcatagcttgaggccaggagtatgagaccagcatgagcaacatagggagaccccgtctctacaaaaaaatttttttaattagccgggcatggtggcatgcacctgtagtcccagctactcagaagactgaaaggaggatcacttgaacccaagaattcaaggctgcagtaagctatgatcatgccactacactccagtctgggcaacaaagagagacatttttatttttatttttatttatttattttttatatatttatttatatatatttatattttttatatatttatttttatttaaaaatagaaatacaaaacttgaaaaatctcaaagacataatgctatgtaaaaagacatagcattttgattctaaataacaaccaaaaaacatacattttgatgctaaataaataacaaccaaaaatatacattttattcataaatatactgtaggaaaagtatcacgcatgagaatgaattatcaccattaggacaattggttaccgggaagagaggggagaaaaaatggagatcgtgggctttattatgttttatttccctaaaaagttttgatttgaagtatatagggcaaaagggtattatctttcaaatatgggtgatgtgaaagggtggctgttatataattcccttcacattactgaatattcttagtgtttcataattagaaataaagtaattagattttgagaagaaagaaattaataactagttatccaatcaaggacaactggactgtagttttcttggtttggttttcataagctacattatagaactataattagtaagactcaataattcaacattgtcatttgacaccatttcagaaaaactctcaagccatgtttccctctgctctcacaatacagcgatcatcaacaccatgaccaaaggtaaggggtgggggcgcgtggggcagtgagggctcagttccaagactgccccacccctcagacacaagcagcaagttcaggcctgtagagctttctttttttctttttcttttcgggtttttttttttttggagacggagtctcgctctctcacccaggctggattgcagtgcacgatctccgctcactgcaaactccgcctcccaggttcaagcgattctcctgcctcagcctcccaagtagctgggactacaggtgcccgccactatgcccggctaatttttatatttttagtagagacggggtttcaccatgttcgccaggctggtctgggctgacttcttatctgggctgacttcttatctgggctgtttgttggctatgaggacctagggatcacagaaaatcctggccattccaggaagcctctaatctgaatgtttttactttattttcagttgacatccattttgcaaaaggaatgcttacagccaggcgagcagccctctaggctgatcctgcaaggttattctcctacaggagacgcccgtgtgtgtcgaaggctggactcctgcccagaccctccacgtgggcacagcagccaggccacgccttgtgccaggggccaagtccacaatgggcagggcgaacagtttctaccctggcaagtctcagggaacatacccttgactctcaactaactgtactatattttctgtatatacctttcaggattttagcttcctcctgcaaatgcactgtaaaccaaaaataaaattccaagcatcccaactaactgaatggacctctcctcttggccaaggcgattccaaagaaacctgtaaaactaattcaggccatgacaggaaggaggggctaggctcagtggctcatgcctataattcagcacattggaaggccaaggctggtggatcacttgaggcaaggatccaagaccagcctggccaacatggcaaaaccttgtctctactaaaaaaaaaaaaaaaaaattagccaggcatggtggtgcatacctgtaatcccagctacttgggcggctgaggcaggagaatcgcttgaacccaggaggttgcagcgagactctgtctcaaaaaaaaaaaaaagacaggaaggaggagtccaacatacctcattattccctcctccattgaagttcaggcacaaatgaccagcattaacattcaaacagaggtctcaagactgacgaaacagactttttgtagaaataaggtatgaaattccaacctgactcaaatacagcatccaaggatatagacagcaggccctgaaacaaatcaagtattttaccccaaaatatttttgacatattttgaaagggccctgcaaagctatctcttgtaggggaaacttacattctgtagagaatccccttccctttccaggtctctttctgatcctgaaaagattacctgagagtctggcagcttttaaaggtctgaacagaaaacatttgctatctattgcctctaagggtagccatctatgagacttcacctacataataagaactttggtctcccaaacctcttatcttaacccagaccctcctttctattgattccaggtctttcattattaatttaactctttcaaccaagcaccaatcagaaaacctttgaatccccctgtgacctgtaagctaccaccctgaccctgccatccccgatctttgagttgtcccacctttccagactgaaccaatgtatacctcacatgtattgatcgagttcctatgtctccctaaatgtataaaaccaagctgtaactcagccaccttgggcacatgttctcaggccctctgggggctgtgtcatgggtcatggtcctcacatttggctcagaataaacctcttcaaacattttacagagtttgacttccttctgtcaacaacacatgtatttattaaaagataattttcagaaagaagtaaaaccatcactcttcaacagatataaaaacaaacaacattgaggattgtactctacttgaacgacaggaaaaaactaacagatgttctaacaggcttgaaggaaaatcaaaagagcacaaatgcagcactggaaagtgtaaactaaaaactctaagcccccaaccaactgactggatcatctcttcaccaaggagaccccagaataaccttaaaaactgagttattggccatacaactcagttatatagttatgggttgggggatcacacacctctcattatccgctcctgactcactaatcaccatgaggctttcttttctaaaggctaaacagaaactagcctcttcaaacaaccccacactgatatcacccagccgcatgacactgccctcctttttgcctgataacaaaacaccaaccatgacatggttctggcctgtctacagagggtgcacagtaaggatttttgtgtcctctgcttcagcttttaacaacagagggccaaaaataccacccttggatcatgctaacgcagtcattttttgaacatggctcccatgaagaggcaaaaagctcaattgcccacgtacacggttctccttcaaaaatattcatggctgagaacagtggctcatgcctatactcccaacactttgggaggccaagacaggaggatcacttgagtccaggagttcaagacctgcctgggcaacacagggagaccccatctctacaaaaaaaaaaaaaattagaaaattagccaggcttggtggcacacacctgtggtcccagccttttaggaggctgagctaggaggagcacttgggcccaggaggtcaagactgcagtgagccaatgatcatgccactgcactccagcctgggggagtgaatgaaaccctgtctcaaaagtattagctaatccattattttaaaaattcataacccctcctatagcttattgaatctgtgtgtttggccacactgttcagcacagatccctgtactattcttcccacactggaagggtctgtttccagcttctggccagagactacacttcccagcctgtcagaatggccgctttgcgggctgcaacactttatgagaaataaagctctctttttccaaatttatgaaactcatcattctttagttgacaaaagaaatgttgagatgaattgcaaatgaagacaaaatatctttttggccaaacgcagtggctcacacctgtaatcccagcactttgggaagctgaggcaagaggattgcttgaggctgggagttagagaccagcctagacaacatgttttttttttaacttttttccacaggaggggaaagagtccattaattctgcatggaaacgggatagaatttacagatctatcagatctgccacttactcctaaaaatggctcaagtacaatgaatggagctggaatcagacagcccacagggcgtgctatagacatgggtacttttccactgaggcactttttacaaatgatgaggtcctttattgtgagtaagaaggtttccttttcctcctgtgctggggcaggactgtgtgtctgagatgcatgacagagtcctcgttacacatgctgtcaataaaggcttttctgtatcatggcagatgtgtttggggccaccttctggtcatccccaggtcagttctgtggtctccactggtgacgtctctggaaatcaggacgcttttcctagctctgtggagtgccctgcaggacaccctggtggccatgttcgtcggcaatgcccacactggccaccaccagcacaaatgcatgattccccatagacattgctgcaaggtgctgcatatgtgtgaatgacttctatgtgatggtatgcacaggagaggagcatatggaattggaatttgcagatcaaatactcaacagtgatccccatgggttttgatgtgtaattttccagagagatttgcttgtgtgaggcagagctggaggggccacaggagtcactctgtaggggtgaaggagcctcactctgcctaacacaagcatgtccctctggaaaattacacatcaaaacccatggggatcactgttgagtgttttttgttttttgttttttgttttttttgagacggagtctcactctgttgcccaggctggagtgcaatggtgcaatctccgctcactgcaacctctgccccactggttcaaacgatattcctgccacagcctcctgagtagctgggattataggcacatgccaccacgcctggctaatttttgtattttagtagagactgggtttcaccatgttggccaggctggtctcaaactcctgacttcaggatacatccacctcggcctcccaaagtgctaggattacaggcatgagccactgtgcccaatcttacagttgagtgtttgatctgcaaattccaagggtatgctcctctcctgcgtgtaccttcacaaggcactcctttactccgtatacatttgcacttcttgacttcttttttgaaccagttacaacatctgcctatttctctctttaatgaataaaataaaatatttatcacttttatatctgtataaaagtcacgatttcacctttggctgaaaattatcttttaacaatgtaatcaaacattccctttctaacactggcagtcagacaggtaagagaggtgataaagtatggtgagggtgtggttttcctgatttcacgccctaaggattcaaataactcacaagtcagacttccaggcacaacgcagttctccaacagaaatagagaaaacagattttgacaagcaaaagggactggtgcagttgggattataacaagcagggaagtctaggaatacatctccagcctcctgggagagcctgagcccggagggggcagagaggaggaggagggaggtctgggggaagagaggtctgcaaagtaggggaagggaaggccaggagggagggaggcgcagcggggaggagaggagagaagggaggaatacatttctggaagctttagaaatttagaaatagaaaccacgtggaagtgcatccagggctcagggttacagaggaccccaagacaacacaggaaagtggggtctaatgggaaaggcaggaggtttctcctttactgcttaaacattgtaggaacttgcatggcaagtgattttcaatcttgcagcagggaaggcagggccagtacttatccttagatgattctacaaacatcaaacttctccaaatatttatttttcagcagccatgcttgtattttccaagtgtctatggtcgagatagcatgaattaggaagctacctggatgagcccacaatggccctcttagacatgccaacgacgcccctgcagaatctgctttttctctggctgttcctaggcctggatagggttcccaggcctggacaggattccccggataccggcgaggctcattactaaccactttattttaaatgggctttgaaaacaacaggtggcatcttccatcagcaagtggacataaatctcagtgcccagtgtttccaaggcctgcccgacccacatggctgtggggtgtaaactgtccagtcgttcctggcacacctacccagcatttaggatgtcccactcttagatccatagacccagcacctctcttcttaatacccaccctaaagaaaagctgtcgaatgtggatgctgatttagttgcaaatatgctcagttttttaatagttttatattagtaaaaacgctacaaccagaatgtctcactgcaggaagagagttacaaggagtatttaacggcatggtggaaaggctcctccgtgctaaatggccaaaacgaacgcaagtttgcatacggtgtgatttccactatgtctttaaaatgcatggcgaaacacctacaggaaaataccaaaatgtaaacagcggctgcttcggacgcatgggatcgtggaggctgctgttctgcaaggacaacgtatcacttttatgaaagtcagcttctgaaaacggactatgggaagttccttacccgtgcacgcggcaaagaccttctttgccatagtcagaacacacgcgggagttcagaggagcggggcccgggcttgtgtgggcttgtgtgccccggggacgcgcacgtaccttgtcccgcggcctgagactgcgctgcaccgcgcggaggccgaacccagaggaggcggcgtggcgccgggcggggacgcgagagggacgtggacgcggcgaccgaggacgcggggatcctgcgggaccagtggctccagtcgtagcctcctgggagagccaagcccggagggggcggagaggtggaggagggaggcctgggggaagagaaatctgcaaagtcggggaagggaaggaaggccaggagggagggaggcgcagtggggaggagacgagagaagggagggagggaagtgtgaggggaggggaagaagtggggtggtcggagggtggggtagggaggaagagggagggagagatgggagaggctccaagataaagaaaggtgcagggagagggggtgggagggagggaaccgcagagaggaagggagaagagaatcaggcagccttgagggaggaggcagggaggccaggagaaggaagacagccagccttctgtgagatttacgtgcgtgcctggcttccaagacaagtaacttctgttgtaaatacaaattaagctattttttgtttattttattttattttattttattttattttattttattttagagatagggtcttattctgtcacccaggctggagtgcagtgacacaatcatagatcactggagcctcgaactcctggcttcaagtgatcctccccttcagcctcccaaagtgctgggattacaggtgtgagccaccatgcccagccacaattttttttttttttttttttttttttgagatggagtctaaccctgttgccgaggctggagtgcagtggcacgatctcaacctcaacctcactgcaacctccacctcccggattcaagtgattctcctgcctcagcttccccagtagctgggattataggcacgcgccaccacgcccagctaatttttgtgttttcaatagagacggagttttaccgtgttggccaggctggtctcgaactcctgacctcaagtgttccacctgcttcggcctcccaaactgccgagattacaggcgtgagccgccgcacccggccccagccccaaattaagcctttttttaaaaaagaaattaatacacgtttcatacttgcctccttcgtattttctctggtcatctgcccaaggttatgacaacagcttcaacttggctgcagaagcacacccctgtggctcactcaaactggaaacatacaggaaaagggaattctaggaatatagctcagcctggacaaatgggcacattaaaaagccattgcaccgtggtggccgcacttcctgccatccccactgcaaaggtgttgttatggactgaatgtttgtgtcccctccaaaatttgtacgttgaaatcctaaccaccccgcccatggtggtatttggaggcggggcctttgggagatgcttaggtcatgagggtggagcccccaagaatgggatttgtgccgttacaaaaagaggcaagggagcttgcttcctcatctgtatgccaggaagaggatactcaccaagaacccaatcctgctggcccatcccagacttccaacttccagaactataagaaataaatgttgtttaagctacccaagtctatctatgatgtttttgttgttgttgttgctgttgctgtttttgagacagagtctcgctgtgtcgcccaggctggagtgcagtggtcccatctcggctctctgcaacctccgcctctcgggttcaagcaattctcctgcctcagcctcctgagtagctgagactacagacatgtaccaccatgcccagctactttttgtatttttagtggagatggggtttcaccatgttggtaaggatggtctcaaacacctgacttcaggtgattcactggcctcggcctcccaaagtgctgggattacaggcatgagccacctcgcccagcctggtgtttttgttatagcagcccaaacggactaaaacagtgttttccttctagagatacactaattttctttcagacaggatctttcaaaacccagtctgaaacatctgcagttgaattattttatgggcttggaatttctctaaaatagtggttagggattttttaaacatcagaataatttaaaaagttaccaaagtgttattacccagaacaaattcagggtcagcgccaaagaaaaaaatttatttactttttttgagacagggtctcactctgtcacccagactggagagcagtggaatgatcacagctcactgcagcctctacttccctgggctcaggtgatcctcccacctcagcctcctaagtagctgggactacaggcatgtcacccaattaagtttttgtttgtttgtttgtttttgtttttgtagagacgggctttcgccctgttgcccaggctgaagaaaaattcttgtttccatcctacaatgcgcaaattgcttgtgacacctaaaaggacaatttttcaacttcaccaattttagtgccaaactccatggaaaattaatcacacaagtgattatttaacctaggttcttaaaaaaattaagtttccttcttacagaaactctcagcagaaatgaactctaagatttcatggagttccctataaattaaagagctatgactcagcgtttgctgctcgttacccctccaaagttatctttatttttcattataaaataggtaactaaattccagggacagaatgagtccaagctgaattaacaaacagggcaaggtcaaagttaaacaaaattgctgactctgctcaaactcctgtgatttacactgaccttgaaggcaaggccaggaaaagtattccttggaattgctcctctaaagacgcttggaacaaaatcagaaaaagtgctgctgtgtttcagaacatctcaaaataatacctgagggcaaacatattctatgtcatctgttaccatttcctggccgtgctgctgactcagcctccagcactccttggtggagctgcagggagcccgctgggaaagcgctgaatcctgtgcacaggaaaggcactgctggtgaagacaggtgagaggctgggtaggtgatttctagaaggttcttgagcaccagtcggccatcttgtcatccccagatagaaagcttaaatttgctttttttttcactttttattaatgaaaatgtacaaacatatagaaaggtagaaagaagaatacaattaattcccatataccccaggcctaaatataattatctttagtattttgctaaacttgcttcatcgatttttttttcaaaagtgtagaaattatagacaacttgacattttaccccttaataattttgtagtagtcagcctccaagatgactcataacgtgccctgcctctgagaaatcacaaccctatgtagtctcctacacttaccatggttggtctgtgtgaccaatagtctaccaacatagtgatggtgtattagtctgttttcatgctgccagtaaagacatacccgagactgggcaatttacaaaagaaagaggtttaatgggcttacagttccacgtggctggggaggcctcacaatcatggtggaagacgaggaggagcaagtgacatcttatgtggatggtggcaggaaaagagagcttgtgcagggaaactccttcctataatacgatcagatcttgtgagacttactcactaacatgagaacagcatgggaaagacctgcccccaggccaggtgccatggctcacgcctgtaatcccagcactttgggaagccaatgtggccagatcacctgaggtcaggagtttgagaccaacctgaccaacatggtgaaaccccgtttctactaaaaatacaaaaaattagctaggcatggtggtgggtgcctgtaatcccagctactcaggaggctgaggcagaagaatctcttgaacccaagagggggaagttgcagtgagctgagattgcaccactgcactccagcctgggtaacaagagcaaaactccatctaaaaaaaaaaaaagacctactcccaggattcattacctcccactgggtccctcccacaacacacaggaattcaagatgagatttgggtgcggacacagccaaaccatatcagatggtacgtctcttccaacattagattagactctgggacttccacctctctcttctctctctctctttctctttctgtgtgtgtgtttctgtgtgtctctgtgtgtgtgtgtctagctttctctctcagatcacatgctgtaggggaagtcagctcccagccatgtcttgagtagcctctggagcaaagaaatcgtgacccacagccatgttcctgggccatcctggacaagaatccttcagcgtcagccaagtgtcagatgccataaccccatggtaacctcctgagagaccctgagccagaaactccaactaagccactcccagactcctgaacctcaaactgtgcaagataataatgtttattgttgtgagctgctaagttttgggctaaattgtgacacagcgattgttagttcacacagatgttgatacctttgataactggaagtggggtgctgctatgacaacacttcatgtgtgatagtgactttggaactgtggctttggattatcgagagtgttagtgaaagccttgatttacccgaaaaaacctgttgataaaagattcacgtcttttgtttttgttttgttttttagagacagggcctcacgctgttgctcaggctgcggtggcatggtcatagctctttgcagcttcaaactcctgagctcaagggatcctcctgagtcagcctcccaaagtgctggattacaggcacatgccaccacactgggcctaagactcggatctttaaagattgcaagtgagcacttgtaggaaagtgaggtcaatgaactagaacctggaggaagggggtccttgttatgcagtggcagacagtttggcaatgctgttgactgcagttatgtagacagaagcaaattagctgggtaatctggccaaggagatcttcaattggtgtttaaagtactacctagttttttctaattccttctagtaagatgctagaagataggtcaacaaaaggaaagacagttaaatataaatgaattagaactggatagttctggaaattctcagtctgcctagatggcaaatgtattaggccgttcttgcactgctatagagaaatacccgggccaggtgtggtagctcacacctgtaatctcagcactttgagaggatcacaaacaaaacaggaggatcacttgagcccaggagtttaagatcagcctgggcaaggtagtgagactccgtctctacaaaaaagtgaaaaaattagccgggtgtggtggtgcatgcctgtagtcccagctacttggaagactgaggtgggaggattgcttgagcaaaggagttcaaggccacagtgagccaagatcacaccactgcactgcagcaatagtcaggctctgtcgctcaagatggagtgcagtggcataatcttggctcactgcagcctcaacctcccaggctcaagtaatcctcccattttagcctcccgaggagctgggaatacaggtgcgaccaccacactcagctatttttaaaatttccttgtagagagagggtttcaccatgttgcccaggctggtctcgaactcctgggctcaagctatctgcctgccttgacctatcgaagtgttgggaccacaggacctggccgtcagacacttacacaagcagatctcgtgggaactcagaacaagatctcacttatcagcaagaggatgactcaagccatccatgagcttcagttttgaatcacccccatgatccaaactcttccctcctaccaggccccacctcaaacactgaggattatatttcaacatgagatttgggtggggacaaatatccaaactatattagcaaattatgaaacaattaagaaatggcttctaagcaaagatcaaatgcaggtcctgccagaaaaactgtggtccaagatgaacccttaggtgtgactgtaagattccaaagagatataaggtggcatctcagagtaccactgagtcagacaaagggcctgctctatagagtaaaggtgcaccccacagcctctctcaatcaaaggagagtgcttctaggaagcttaggggctttgtccctcagctgtctgcagaagccaaaggtagagaacagatttgtgggtgttgcatttgtctatggagtgaaccccaataaaattcacagaaaatccatagtttaagagaattgtatatacggaaatgttaccagcttggactgaaaggaacagaaataatacaacctaaaaagaagaccttatttgttacttattttggggggaggggacagggtcttgctctgtcaatcaggctggagtgcagtggcacgatcttggctcactgcagcctggacctcctgggctaaaacaatcctcccacctcagcctccccagtagctgggactactggcacatgtcatcatacctaattagccatgtcataatggctaattttgtttttattttttgtagcaatgagggtttcactatgttgcccaggctggtctcgaactcctgggctgaagttatccttccaccccagcctcccaaagtgctgggattacaggaatgagctacaatgactggccaaaaagaagaccctaaaaattctactgtcaagcagtggactgaggctgctcctcagccacacacgacaccttttttttctccctttgtgaacaggggcgtctggagtagttattctgtgttctcttacatgttcaattggggagggagaggcagaggtagacagacaacctatcaagaagaattataatgtagaaactgtatttaaggaaataaagtcccacctggacttgatttagatgatctggagatggaactgatgctacaataggataagcctttggggaactttggaaggagttgatggtattttgcatgtgggaaggatgtgaagctttggagaccagaaggtggactgtggctgtctgctggctggcctgtactgattctcacctctagcagtcatacccttcagtagtccccaaccccgctgtgcctcatcgcaccatagttggtctgtgagaccaatgacatgcaacagaagtaatgtgctatggtttgaatgtttgtccctgccaaagctcacgttgaaatttaatcctaaatgtggcagtgctgagaggtggggcctttaggaggtgattgggtcatgagggcaaaatggatcaatccattcatggattcatgaatttatcttgggagtgaaactggtggctttataagaagaggaagatctacctgagctagcacgctcagtctccctgccgcctgctgccctgcactccttgggactctgcaggctccgccagcaagaaggccctcgccagatgcagcccctcaactctggactgcttggccaccataactgtaagaaacaagttcttttactttgcaaattactcagttttaagtgttctgttataagctacagaaaaacggataaaacataacaggctgtcacttctgatgttaacttatttttataagtggcttcatcttggcctctattttccactcttgctccctctgtcagatcacttgctctgggaggtgccagcagccctgtgaggaggcccacgtggtgaagaactgaggctgctggccagagccagccatgagcggaggcttctttccaggatccatgtggctgggtcatcttggacacaaatcctccagccccagtgaagtttcagatgactgcagctctggccaacatcttgatggtcacttcctgagagaccctgtgccggaaccatgggctaagccacccccagattcctgaccctcaaaaactgtatgaaatactacatatgcgtgttttacatcactaagtgtattaagcatgtgtttctttttcttttcctttttttttttttttttgagatgaagtcccactctgtcacccaggctggagtgcaatagcacgatctcgcctcactgcaacctctgttccctgggtttagcaactctcccacgtcagcctcccaagtagctgggactacaggcacgcaccaccacacccagctaatttttttgtatttttagtaaaaacggggtttcaccatgttggccaagctggttttgaactcttgacctcaagtgatctgcccgcctcggcctcccaaagtgccgggattacaggcctgagccaccacgcctggcccaagcatgtgtttctgattttttcacaggtggggccttgcggaccctggaaaggctgcccttcctggggctggccagttcctactggagagagtgcctgcctttcaaatgccaaccaaccaatccagagcccctactgcaccacctccttcactgagctctcacactgttgcaggacttctccttagttcagctaaagatggagtccttatcacacaggcacgaaaattgaggcttgcagacaattgaagagtgagaaaaacggggtttattgggcaaaaagaaaaaaatgggaaagagagacttttagcaaagcaagagagtgttcttcctgcctgtgggcttcccgcctcgcagattgaattccaggttccacacaggaagaggaggggccaagctcctcccctccgcaaactgcgtgaactactatggctccgctccagtacgcaggtaggtccgaggctctgccagggagcccttcccacctggctgcctcatcagggctctcagggccactatccacctgcactaatgactctagggccaggtaccagacaactagagttggcccttatgccccggagcctgccgaaagtattcagactcaccaatcctactcctgcttatcctgccttgcccattcctattcaaaaaccacagtcaagcctcttgttcacatttgccctgctccttctgcttcttgacccaccacggtgcttcccagcgtagccacttgtggcatagtgtgtttctttttctatctttttttttttttttttgagacacagtcttgctctatggcccaggctgccaggctggagtgcagtggcccgatctcagctcactgcaacctctggctctcggattcaagcgattctcctgcctcagcctcccgagtagctgggattacaggcgcccgccaccacacccggctaatttttgtgtttttagtagagacagggtttcaccatgttggccaggctggtctcaaactcctgatctcaagtcatccacctgcctcggcctcccaaagtgctgggattacaggcgtgagccaccgcgcctggcagcttttggttcttttatctctgtagtcttttttaacctaaataacccctttggtgattttaattttaaaatatgtccacaatgctttttcccttccttccttccttccttctttccttccttccttccttccttccttccttccttccttccttccttcctttctttccttccttccttccttccttctttcttctctttccttctttcttttttctttctttcttctctctttccttctttctttcttttcatttctttctttctctctctcctctctctctttcccttcctcccttcctctctctctttctttctctcactctctcctctctctttttcccttcctcccttcctccctttctctctctctctccctctctccctctccctctcccccctctctccctctcccccctctctccctctccccccctctctccctctccccctctctctccctctctctccctctctctccttctctctccttctctctccctctttctctctctctctctctttcgtgacagggtctcactctatcgcccaggccggagttcagtggcatgtgccatgatctcagcttatggcaacctgttcctcccgggttcaaataattctcctgcctcagcctcctgagtagctgggattacaggcatgcaccaccacacctggctacctggctaatttttataattttagtagagaggggtttcacagtgttggccaggctggtgtgaaactcctggcctcaagtgatccgcctcagcttcccaaagtgctgggattacaggtgtgagccaccgcaccaggccccacaaatgctttgactctctgcattcaaaagacacagcttccccttgagtgtgggctgtacttagtgagtcacttctaataactagaatctggcaaaagtaaaagcctgtgccttccgggactaggtcataaaaagcatgtggctttccccttgatttctcttgggccaccttgtgagctgttgtttactggtgttttaagtgttggagtaacttattactcagcaatagataactgagacagtgtccatttaactcactcctttaccatatttcctgtgaaccagaaattaaatgtagaggctagattagtttcaggttaaacatttttgacaagaatatttatagactgtcttaagaactgtcacaataaatcaggaggtacatgctagatactctactattcgtggtgttaagtttgatcacttggttccattactaaatatctcataccatgtggtagagtagattattgcccagaaatcctccctggcccatccagttctcataagaggggtgtttttccgatctcactgctacttggctcagccatgggacttgctttggccaataggatattagtatacatgatgcaagttgaggcttgaagcatgctagtgtgcttgggcctgccttcctgtgtctgccattaccacgagaagggcttctcccagacagctgtcctcccctgaacctgagccccagccagagtcatcccttgaagcagcactgtccagccaagcccagtctacatcagctggcctccagatctgtgaaaataaataatgttgttttcaggcacttcattttgggttggtgtttttaggcagcacgcacagccaaacgagattgctgctacattcaccagcctgcttttctcagagaatcagcctgctggtccataggtgtgggcatgcagctgccatgtttagacagcaagatcctgcccccgagaccatggtggatcagactagggtgggcacctgatgtaagttagacctttgatttagggtgacagtaaactagctagtgtgcgggaatagtaacagataaatgcaggagccgtgggttggccatattctgctagggaagcaggtctaatatgagaagaaacaatgaagaagatgaaaattagggagggtcctgccaatgttttaggttccggctcccatccctttcagaggcccagatccaccctgaccttcagttctagcaaactccatccttaaaattgtcccttttacatttcagataatgtcacttgtcaactgaggaatgacaaggttcataaacctagaaagaagagctttcttctcataaagggctgcagcctgcagggcagccattgtgacaggctgagaagcagagcctccagccagaagccagaaacagacccttccaggggcagaagaacaagacaggaatttatgctgaatgaggtaccaaatacacacatttgataagctatgggaggagcattgaatattgatgagaagagacataggcacatgtgcagtcgagctccatgcctctccctgggacctgtgttcaaaaaatggcagggttagcacgatccgagggtggagttttcaggcctctgacatcaaaagatgagtcagaggacatgaaaatcctcactgtgcatccttcagagatctgccagaacgacttcgtggccagcagtctcttatctaactactccgcagctagtagtcctcttaagcaaggatgccggtcagttattttgtccagaccacatgagggcagggcagcattaggtggctggttgataccaggagtgaagcctctttcccaagggttggtttctgtttagacccctaggaaggaaagcctcatggtcgttatccagggcatcggggtataatgaggcgtgtccaaccttccataccatcatggtcaggaactcagttttcaaggtttctctggggtccccttggccaggagggagtctggagaccgtcagttgcttaggaggcttagaatttcacttttatttctcatactggatttctagcaacttttaaaaaattttttgagacaggttctcactgtgttacccaggctggagtgcagtggctcggtctccagtgacgcaagctccctgcaacctctgcctcccaggttcaagcgattcttatgcctcagcctctccagtagctgggattacaggcatgtgtcactatacctgactaatttttgtattttttagtagagacagggtttcaccatgttggccaggctggtctcgaactcctgacctcaagtgatccacccaccttggcctcccaaagtgctgggattacaggcatgagccaccgcgccctgcctatatttgcaatttaagattcgtaatacacatgcctgaaccaacttcatacaggtatgcccctgaccagacctatattaatttcttgtggctgtcataacaaatgaccagaagcttggtggattcaaacaacagaaacgtattctttcacagttctgaagaccgcaagtctggcagggtgtgacccctctgaagactctaggggagtgtattattctgatctcacattgctataaacaactgcctgtggctgagtgcagtggctcacacctgtaatcccagcactttgggaggcctaggtgggcggatcacttgaggtcagaagttcgagaccagcctggccaagatggtgaaaccccatctctactaaaaatacaaaaaaaaaaaaaaattagctgggtgcagtggtgcatgcctgtaatcccagctactcgggaggctgaggcaggagaatcgcttgaacccaggaggcagaggttacagtgagctgagatcatgccattgtactccagcctggacaacaagagtgaaactctgtctcaaaagaaaagaaaagaactacctgagactgggtaatttatgaagaaaagaggtttaattgactgacagttccacaggctgtagaggaagcatggctggaaggcctcaggagacctacaatcatggtggaaggggaaggggaagctggcacatcttcacctggctggagcaggagaagagagagggaagggggaggtgccacacactctaaacaaccagatcttgagaactcatgatgaggagaacagcaaaggggaagtccactcccccacccccatgatccaatcacctcccaccaggcccctcctccaacactgaggctgacaatttgacaggagatttgggtggggcacagaaccaaaccatatcaaggagaatcccttcttgcctcttctggcttctggaggatccacgtgttccttggcttttggccgcatcactccaatctctgtccccctccgtgggctgcatcatcttctgtcttttacaaggacacttcttgaatttagggcccacccagatcatccaggaagatcccatctcaagatgcttgacttaatcacatccgcaaagaccctttttcctaataagctcacattaatgaattctgggtattagggcaagcacctcatacctcaggcaggattcttgccaggcctcagtcagaataccctcaaaacttggtgcatctaccaggagcgggggctcatgcctgtaatcccaacactttgggaggctgaggcagacagatcactagagattgggagttcgagaccagcctggccaacatagtgaaaccccgtctctacaaaaaatacaaagattagctaggcatcgtggcatatgcctatcatcccagctactcaggagtttgaggcatgagaatggcttgaacctgggaggcaggttgcagtgagccaagatgttgccactgcactgcagcctgggtgacagagtgagactccgtctcaaaaaaaagaaaaaaaaattggtgcgttatatcgattccaaacatatagcattttaaatatccacaaaagttgtgtgtggtctgaaaaataagaaaaagcaagattcaaacaagttttaaattcgttcatattgaaaggaacaaggatttacatatttatggatccctattaaagtcaaaggtgtttgaattaagcaaagtgtataactgaagtgtagcaacataggccacgctaacacttcttcaggttatgggggtgggtcattgacaaagcaactgtagaaagggctctgcatgacgaatggcagtgggaagagtcattcgagatccctgcagcattgggactcccgtttgcctacagtccccgaccttagtggccttaattaaccagcatggtaactatccttttttttttcttccagaccgagtctcgctctgtcccccaggctggagtgcggtggtgtcatctcggctcactgcagcctccacctcccaggttcaagtgattctcctgcctcagcctctggagcagctggggttacaggtgtgcaccaccacaccaggctaatttttgtatttttagtagagatggggttttgccatgtgggccagactggtctcaaaactcgtgacctcagatgatccacccaccatggcctcccaaaatgctgggattaccagtatcatgaaatgcaggtgagccaccgcacccagccatctctctttttactactcagcaaccttggcacacgccaccatgcctgaagaattgttttaagtcattttttgcagagatgggtggggtctagctatgtttcccaggctggtttccaagtcttggcctccagtgatccttccacctcagcctcccaaagtgctgggattacaggcatgaaccaccataaccagacaggtatgtatcttttggttggagaagatttataattaagtactgaaaacttgtgagactcaaaaccataccatagtattaatatgaaatttgtttaaatagggatatgtgcatttttggtattttatgttcttaatatagttaagggaatttggcctgttagaaaggtcagacatgtaacataaagttaaaaggtatgagtaaatagttaatttagacttgtgatttaaggatgaagtctcattttatttaccatattgaaatgctcaggagagaatttgtttttcttcctttgcaaatttaatgtattagatttcctataattatttagtattcgggaatttttgttgttaattcagacagcaaaagtactctaaaaggaaatcagttacattaaatttataaatgttgttgaaaaggtttgaagatggttaattaactaagttaggctgggcgcagtggctcacacttatcatcctagcaagttgggaggctaaggcgggcagatcgcttgagttcaggagttggagaccagtctgggcaacatggtgaaaccccatctctacagaaaataaaaaaattagccagacatggtggtgagtgcctgtagtcccagctacttagggggctgaggtgaaaggatcactcgagcccaggaggttgaggctgcagtgagccaagatcacaccactgactccagcctgggtgacaaagtgagaccttgtctcaaaaaaaaaaaaaaatcttttcttttttaattaactaagttagtaaataagaccaagtaatatccaaagacctcttaaaacagattcctgagtatcctagatgtataagaaaaatgagatctataacctaaactttaatgactaatgaaagaatacacatttaggatttgtacatttaatatgttgaaaatcaaaacataaagccaaaatgaacatctgcatagttcctctgtacctacaagctaccctcaaggataccaaaaacctcgttttaacaaatccatgccatcccttgtccatttctggctgccaatgtattgaatgctttttaaggtccaactacaatgcaccaagttaaaatgtttttttaattcctacctttctgtaattcagatcacatgttacactgccctgctctaaaccaccattttacttgatttaaaactattatgtgaactctaagtgctttgcttgagttgtcatggtttgtgaaatgtgttaagtcatggtagttaagcggcagagctctgagctctggagcagactgcttgcgtgcaaatcagagctctgctgctgtgcttaactctccatgcctctttgctcatctgtaaaagggggtagaaattgtgtctactgcacacaaactattttaaggattaaactgtatgactaacagattaaattgtatgttaagtgcttagaacaatgcctggtacttggtaaacattcaatcaataaataagatactatcatgtttgtgaacttcagtgttcctaaactgtaccatgacattgcaagctcattgtgcaaagagatcagtcttactgagttgaatatagaggcgggatttctcagtctctgcagcaaggtggctgggttcaaagaaatggattctggatccaatgcttattcaaacagcagccttggtgagctgactagaaaaacaatccccttagtcatcaattaatttttctatctacaaagcaagatgacaaagggcagcaatgtggaggaaggtatctcttatctctgttccaaacgagagctttcctaaaatttgatggacagtgtgatgggtaatattatgtatcactttggctaggctatggtgtccagtagtttggtcaaacacgagtctggttgttgctgtgaagttaatttgtagatgtgattaacatttaaatcagttgactttaaataaaggagatttttacccttgataacgtaggtgaccctcatccaatcagttggcctcaagagcgaagcctgaggcttcactgagaataaggaattctgcttcaagactgtaatatagaaatcctgcctgagttttcagcctgccaacctgccctacagatttcagacttgccaagttccatagttgcataagccagttccttaaaataaatctctatctatgttagtctgctagggctaccatacaaagtaccacaaactgggtggcttaaacaacagaattttattctttcacagttctggaggccagaagtccaagatcaaggtgctggcagggctggtgtctgttgaggcctttcttcttgacttgcagatacttgcttctcgctgtgtcctcacatggcctttcttctgtgtacctgcagagcaagagatctcttggtgcctcttcctcttcttacaaggaccgcagtcctgttgggttagagccccacccttaggatttcatttactcttaatcacgcccctcagggccctatctccaaatacaaacacactggggttagggcttcaacctatgaatttggggaggacacagtccagggcggaactctatccatctgtctgtctgtctgtctgtgtctatctccctatctgtctgtctgtctctgtctgtcatctatctatgtatcttctgtctgtctgtctttctatacatgtatctatctatccatccatcctatttgttctgtttctctgaaggcccttaattgacacagcagaatgaaatatgacacttcatcatatacagtcattcagctgactccagtgctggcctttataatccatccaacctattggttgtttaatgtaagcggttacacctagattttcttttttttttttttttttgagacagagtcttgttctattgcccaggctggagtgcagtggcatggtctcagctcactgcaacctccacctcccagattcaagcaattctcctgcctcagtttcccgagtagctgggattacaggtgcatgccaccacacccagctaattttttgtattttttagtagagacggggtttcaccatgttgcccaggctggtctcgaattcttgagctcaggcaatccacccgccttggcctcccaaagtgctaggattacaggcgtgagccattgcacctggcctggttgcacctagattttctaaaaataaaagcttaactcctcccctgaaactacttgagtacttttttttttttttgagacggagtcttgctctgtcgcccaagctggagtgcagtggcgtgatctaggctcactgcaagctctacctcctgggttcacgccattctcctccctcagcctcccaagtagctgggactacaggcgcccgccaccacgcccagctaatttttttgtgtttttagcagagacagggtttcaccgtgttagccaggatggtctcgatctcctgacctcatgatccacccacctcggcctcccgaagtgctgggattacaggcatgagccaacacacctggcctttttttttttgtttgagacagagtctcgctctgtcacccaggctggagtgcagtggtacaatctcggctcactgcaacctccgcctcccaggttcaactgatcctcccacctcagcctcctgagtagctgggtctacaggcacacccaccacgcccagctaatttttgtatttttagtagagatagggtttcgccatgttggccaggctggtctcgaactcctgacctcaggtgatccacccacctcagcctcccagagtgctgggattacaggtatgaaccaccgtgcccggctcttgagtaaattcttgaaataaaaagtaaagtatcataaactactgtttaatatttctgctgacaaagtagctttgaaatcaacagcgttacaggtttttgtttatttgttgtttgtgagacagggtcttgctctgttgtacaggcgggagtgcagtggtgtgagcatggctcactgcatccttgagctcctgggctcaatgtgcctgtgccgggccttgcattactgttgttgttgttgttcctaattgccaggcctgtgaatattgcattacagttctatgaattaaaatgaagaggccaggcgcagtggctcaggcctgtaatcctagcactttgggaggctgaggcaggtggattgcctgagcttaggagttcaaaaccagcctgggcaacatggtgaaactccatctctactaaaaatacaaaaaattagctgggtgtggtggcacgcacctgtaatcccacctactcagaggctgaggcaggagaatcgcttgaacctgggaggcggaggttgcagtgagccgagattgtgccactgcactccagcctgggcgacagagcgaaattctgtccccaaaaaataaaaaaatgaaaaaataaaattttaaaaataaaaataaaatgaagacatgtttatagcagctctatttgtaattgcccctaactggaaacaactcagacatctctcagtgaacgaatggataaacaaatcttagtaacccatataatgaaatactactcagattttctttcttttttttttctttttttcttttttttttttttttgagacggagtcttgctctgttgcccaggctggagtgtagtggtgcgatctcggctcactgcaacctctgccctctgagttcaagcaattctcctgcctcatcctcccaagtaactgggattacagacgccggccaccgtgcccggctaatttttttttttcttgtatttttagtagagacagggtttcaccatcttggccaggctgatcttgaactcctgatctcgtgatccacccgcctcggcctcccaaagtgctgggattacaggcatgagccaccgcgcctggcctactcagatatttttttaaaagtattcatacatcttaaaacatgaatgaataagtgaaagaggtcagtctcaaaaggttaccacctacctgactccattgatacgtcactctgaaaggtgaccctgcaggaagggaaacctggtgattgtgaatggctgaggtcgggggtgggtttgacagcaaaaacgtacttgagggggttttctgagggaaggaaattgctctgtgtcctgattttggtggtggatacatatatctgtactatctatacacctgttaaactcacagaactgtacaccaaacttgaaagtcaattttggctgggcacaatggctcacacctgtaatccaaaactttggaggccaaagcaggaggattgcttgagccttggagtttgagatcagcctgggcaacatagtgagaccattttatagtatgcaaattaaaataatgtaaaatgcagaaatagacaaatattatataacatagacaataatttcttttcttttctttcctttttttaatttttgagacagggtctcgctctcctgcccaggctggaatgcaatggcacaatcactgctcacttgcagcctccatctcccagacctaagctctccttctacctcagcctcctgagtagatgggaccagaggcatgtgccactgtgcccggctgatttttgtatttttttggcgagacagggtctccctatgttgcccaggctgagctggggctcctgggctcaagcgatccttctgtttcggcctcccaaagtgttgggattacaggtgtgaacccaccacgtttgacaataatttcttgttcttttttctccaggtatttgctgctcagaattggcaaatagaggaataaactctgttaccaaattccttaatttcaggagaacccatgaaaggagtatcatccaatcaggtgggttttttccactaaaacaacagagaagttcttcctgaaatcataacctgggggcataagttttaattcaaattcttgcaagtgatgtcatgatgtcagggtgagaccacagagtacagggaaaccgcatccttttggaaacagcaatgtctactagtgcagagagagctgctttgaagaaagggcagaaagggagagcacgatttcactaatgcaaacggcagtgaagtgcaaaggagggcagcctccggctccttccagttgggagcgagcaaagcactggaaagggcaaaatgaggcacaatcaccatcatcaaacccctttatcaagttctttttttttttttaaggccgggtctcactcttgttgcctaggctggagtacagtggtgcgatctcagctcactgcaatctccacctcctgggttcaagtgattctcctgcctcagcctcccaagtagctgggattacaggcatgtgccaccatgctcagctaatttcgtatttttagtagagatgggttttcaccatgttggtcaggctggcctcaaactcctgacttctggcatgagccactgtgcccagcatcaagttctttttcttttctccctgactagctcttagtctcaatgatcaaactcctcaggcatgttaagtgggtaaagagtattttattttggcatttgaatctaaaatcataggctttcttgaacaaccttgctttcttatttcaaaggtgaaaccctactctactgttccggaaagtttggaaatgtctcatttctttttagagatgaggtctatttttataggaaaatgaatccatcctgtcaccttttaggatactatttgcattaattatgtactgctgcagaacaaatgtccctaaaacttagtagcttaaaacaacaatgtattgttcctcacgattctgctggtctcatctgggctcactgagactggagggtctagatgacttcattcctatgtctggggccttggtacagctgccggctggacttttcatccgtggaccctgggtgttccaagtgattaaaaatggaatttacaatacttcttaaggcctattctcagaggcttcacaatgtcacttctgctgcattttattggttacaacaagtctcaaggccagctcagagtcaagggatagagaaataggtcccacctcttgatttcgggagaagcagcaaagtcacattgcaaaggagtgaggacacagggacactattcactaggggccatggctgtaacagtctaccatacaattgttagtgatgtttaaagtggatataaacattgattaaattgctcttggctctgaaccattagtaaactggatgaaattcggctaaagatgaattttggattggaagcccacattcagctcagctttaatgtagttaacccttatttcaaaactatgagaaattacttatagatgagtcagagaaccttgaccccctgtttttttatggggattttaactatcaacttagagaaaagtaatgtgggatccattagctattttaaatgcactattattctctaattgtaggtcaactctctttggtttcctaatgtctaaacatttcacaatttatggaattatgaaaggatccagctccccagaggatgtgagcacatctgaacacaattatgcactgcagccagacaactgttagctttctggggcaaaagacacagagaaagaccaggataatccttgtgcgtgcagctcagatttggcccctgtcgccacacgctgccaagcctgtcacattctggcaataaggagcaatgcttggatggggaccaggaccatgctgacatctgaccacctctgcagtctgggcgaattccaagaaatccctcagaagaaagtgccatgcagaaatatcctggcgggggaactgcccacacagctgtgccagttattcaccctcgccagattcttcatgctctttcccacttcaaggcccttgcattagctgttctccctgaccatgcacttgactctcaagaacatttaggtaagtcatgtccttacctaagcttaggggcttaagcgagggacttggtgtcctggaagtactccctagctcgccactctatgtagcacccagtccagatcttcagcctccatccatcctttgagaatgttttatcctctgatcccttgagatatgggccctttctgtgacccaccagcctgtgccagagcccagggccttaattctggaggagacatgatgctaccctgggaacaggtccttccgggacacgaggcagctggagagctctgggtgtgacagaggaatacggaaacagggagaagaaacaaagaaacagagaaatgaggaaacgaggaaggaaaagggtggctcctggagacaaatgtttccttctccacacttctgctgatgctgaggtggcctttaaagtgccagcaaggaggagccgggaggggtttgcacatgtgttgctgggcatggatggggtggtgtgtgtgccaggatgggagccttcctgggcagtcactactgggtggggcgctccagtcaagacatcaagacagacagctaaggctttctcccaaaccaaaagacttgcaaacttccctacaagttctgagttttcttctgaagctaacttcttggaactcaatggcatgaaaccgtcatgcagttaaagcatttaagggctgtatatgccctgggggctgtcaatgtcatagacactgtcatttctctctccctgcacaaaaataactaaaatgatgaatccggctggctctcccctctccctcgctatcctccaccttttatgcagtcctgcggacattctgatctgtttcctcctccccatcctccccttccctcccaagtatactctcagctcttcgtggtctctctctcccaactgcagcctcccccaagactccatcttcaggcctccttccctcaccatctccaaggctgcggctccaggacacaagctgaccaccctgcccaacccgaagtcctcgactgatgctcagcgcttataggttcaagtccaggctccctagcatagcactgaagtcatggctcagtttacccttccaagcctgtctcccccaagtcctgccctcctcctctcatcactgccaagtacatcaagcactcccacgtggctgggctttaacccaagctgctctctcttcccagaaggctcttctctgacttgctgccaaaacacaaagtcgcttggaggtgaaggcaaatattagttcagctggcaagctcctctccacgtcctcatcaaagcccccagctccatgagcttctgggctgttcctgtggatttctgcactctctgtgttgaaacatctgtaatgggttatagctgggagttggaatgtctgcctcccttttcgctgagaagaagggggtctttacaggatcgaacgctccctgggttctgtctccttcctttcaatatagtgagcagttcctcccacctagtgggttctccttagatgtctgggaggtcatctatccagtgctggctgttgcagatctgtgcagttgctttttgaacaggacccacatccgtcttccaaaatatctaaaattaggtctttgacagttcctgaaaatgttagttatcatataatccagcaactccactccaaggtatatagccaaaagaattgaaatcatattccacacaaaaatgtatacctgaatgctcatagcagcattattcacaatagccaagaaatggaaaccacccaaatgtccatcaacccacaaaggcataagtgaactgtgatatacccatacgacagaataccgtttggctataaaaggagggaccgattcgtgctacaatgcggatgggccttgaaaacatgctaagtgcaagacgccagttacaaaagatcacatattatgtgatttcattcatgtgaaatgtccagaaatagtcaaatttatagagaaagaaagcagattagtggtcgccaggagctggggcaaaggagggcgtgagcgtgattgtgaataggtatggctttttagagaggaaagggggttgtggtcatggtcgcacagcatgtgactcatggagtttgtgcccttgagaggagggactgctgtggcatgtgagttacatataattaggccttcagtgctgccagcattctcatccttggagggccaggtatcttttctgttgttttgttttgttttgttttatgagatggagtctcactgtcacccaggctggagtgcaatggtgagatctccgctcactgcaatctccatctcccaggttcatgcgattctcctgcctcagcctcccaagtagctgggaccacaggcacctgccaccacgcccagctattttttttttttttttggtatttttagtacagacggggtttcaccatgttggccagggtggtctcgatttcccgacctcgtgatctgcccgcctcagcctcccaaagtgctgggcttacaggcgttagccaccgcgccccaccgtatcttttcggttctaagcacaagacaattgtcttgggaacacctcccggctcttggcctcagtatgttttctttagccctacgtttcccctttgctctctccccgcgtgtgatgggggctgcctgggtggggctgtcacagcggcaggtgggtgaggagcccctaggcgcgtccggaggaaggctcacccggaggccgcctgcaggcggccaggtgccagccactgcgggcctctggggccgaagccggcggatggtgagacgctggttggtctgcaacactgcccagaccccgggcactcatgtctagaaaaaagctgactcgtgacaccaaaggagctctttcaagcttcctgcacgctcttagcgccagagcaccccagccgtcctgggagcccccgaagccaagcatattcgaactccgaatccgctcgatcgccggggacctgccatctgggttcggttccccaaggtcgctgccgaccttagaccgcgggggtgtggggcgccggggaaggagacagaaggacaggcgccgcccagggccgcggggacacttggggctgcgtcctgggtgggcgcgatgctcccccagaacgactggagatggagagtgtcggggagggaaacgggacccacgaattcagggcgctgagtcggcggaatgcgccctgactccccctggccgagagccggctcagaatgaaagagcgcggagtgggaggtctgggaaatggcagtatttgtattagggagagaaggaaacaggagtgggagccgcacggcttggggaacgcgggagatcgcggattgcggggatagcgcagcgcggctgcccggggctgctgggaggggccggacgaggccagggcgagcggggtaactgcggccggccggacggcggcggtaaccggctgcaccgaggtggttccaccaccgcgctgggcgcttgcggttcgtctgctccaacgaaagccgcgtcccacgctccctgccgccgcgtggttttgcctcctcagaggggcagcggcgacccaggggctggcggtggatgtcaggagtgcgctttccttctaggccttctccctcatgactggttttgtttttagattacaaaaataacttatattatttaattaaaaatacataaaatatattgtgatagcgcagaataatggccctccaagaatgtccacggcctaatgtctagaaactgttatatggcaaaataaatacataaataaggtggaaggcctttgcagatgtgatcaagctaaggatttttttatttttatttgatattgattgattgattgattgagacagtcttcctctgtctcccaggctgaagtgcagtggcgcgatcccggctcactgtaacctccgcctcctgggttcaagcgattttcctgcctcagcctcccgagtagctgggattacaggctcctgccatcacgcctggctaattctcgtattttagtagagacaggggtttcaccatgttgaccaggctgatctcgaattcctgacctcaagtgatccgtctgccttggcttcccaaagtgctgggatgacagatgtgagccacagcgcctggcaaactaaggatttttagaccggggattaccctggattatccaggtggatacaatgtccagtgatcacaggggtcctagaagagggaggcaggggaggcagaggagaagtgagggcagaaggagaggtcagagggatgtgtttgcttcgaggatcaaagaaggggagcaccggccaagggatgcgggcagcttctagaaggtgggaaaggcaaggatatggattctccctgagcctccagaaggaacccagttctgcagacactttgatgttagcccagtgtgaccctatgcatacttctgacctccagaactgtgcaagaataatctgtgttgttttaggcccctcaatctgtggcgatttgttataggagtcctaggaaatacctgaacacaaacatttaaaacataaagaagtcacctgtaatccacttcccagaatgaactcattcagcagcctgaggagcagggctgactgatgaaaacacttgaaaggaggaagtgccgtcttgctaaggctggtgtgttcagaagaggacaccgtgaatgattctcctgactaagatggtccactaaaaggaaccagggctccgtggagaaatggcgacttctgggattaaggctggagaggaataagatgaacccagaatatattattctggcagacagtgaggaagtacccagagaatggtaggaactcatccaaaggacaaaagcttgaaggggctctcattgggcaaatctggaatcttttgagtaacaatcatgttagtattgaattgtaactcttttttttttctttttgtagctgggattacagatgcctgccactatgcctggctgatttttgtatttttaatagagatggggttttgccatgtcggccaggctggtcttgaactcctggtctcaagtgattggctcacctcggcttcccaaagtgctgagattaccggtgtgagctaccacacccggcctataactcttcttactttattataagcacagtctaagaatccactagtacctacaggtacagtaatataaatgaaaaagtaaagagggagaagaaaactctttcttatcaactaataaacgcagaaagataatggaataagaaaataccgcttggaactaccatagtaatgattatgtcagggagaatcatcagtgaatgctaaattgtgagaaaagtttgagaaacaggatttgtatatggtctcaaactatcgctgcacgagggagattcccagtaatgaccgaggggaaaacagtcactttactgtggggaaacctgacaaaccttattcaagcgatcaaagttaacatcaccagcaatgggacaaataggcaacacgtgcctctggtgtgctgcagcaggcctccatgatgcaatagcccttcatggtgctcgtgctggccgtgcagaacctgcattcaattgtgaggaaataccaacacatcaaacagagggacattttctaaaacactggcttctgccctacaaaaatgtcaatgtcatttttgacaaagactgaggaactgtttcttactgaagaggactaaagaggcctgacaactaagtgcagtgtggattctgaatagtgggccagatgaaaaatgtttgtttgtttgttggtttgttttaattataaaggaagtgaatcatactaaggcatagatgaaccttgaggacactgtgtgcgatgaaataatccagacacgccaggcgcggtggctcgtgcctgtaatcacagacagcactttcggaggctgaggcaggcagattgcttgagctcaggagttccagaccagtttgggaaacatggtgaaatcccacctatgcaaaaattagctgggcatggtgtcccaagcttgcagtcccagctacttaggggaggtggaggccgcagtgagctgtgatcaggcctctgcactccagcctgggtgacaaagagagaccctttctcaaaaaaaaaaaaaaagtccaggcacggtggctcatgcttgtaatcccagcactttgataggccgaggcgggtggatcgcctgaggtcaggagttctagaccagcctggccaacatggtgaaaccccgtctctactaaaaatataaaaattagccgggattggtggtgggcacctgtaatctcagctacttgggaggctgaggcatgagaatcacttgaacccaggagacggacgttgcagtgagccaagatcacaccactgcactccagcctgggcgacaaagtgagactctgtctcaaaaagaaaaacaaaacaaaacaaaaagtagaaaaaaagagaaataatccagtcacaaaatgacaaattatcgtgtcattccacttatatgaagtaccaagaatagtcaaatttatagagacaaaaagtagatggagggttaccaggagcttggaggaggggaaatggggacttcgtgtttaatgtgttcagagtttccgtttggggtaacgggagatggataattgtgatggctgcatagcactgtgaatgtaatcaatgccataagttgtacttttaatggttaaagtggtaaatcttacacatattttactataataaaaataatttctgaaaaaaagtcttcaactttcaaataaatgggtagacaattgacaacatttacataaggtctgtagattatataataatggtatgtcaagattaatttcctcatcctgataaatgtactgtggttatgtaagaaaatgtcagctggtccaaaggtagtgagttatctcaattgattgttcccagacagttacagatcaaactccttctactctttccccgcttctcaccactgcacttgactagttttaagataaataaaatgtctgtgtgtgtgtgtctgtgtgtatgtatgtgtaagaaatatacattggggccgggcatggtggcttacgcctataatcccaacagtttggaaggccaaggcgggtgaatcacctgaggtcaggagttcgagaccagcctggccaacatggtgaaaccccgtctctactaaaaatgcaaaaattagctgggtgtggtggcgcatgcctataaccccagctactctggaggctgaggcacgagaatcgcttgaacctgggaggcggcggctgcagtgagccaagatcacaccactgcactccagcctgggtgacagagcaagactttgtctcaaaaaaaaaaaaaaaaagaaatatacattgaggtatttagggacaacaaggcatcatgtctacaatcccctaaatggttagaaaaagtaatatatacaagttatacctgtatgggcagagagaaagagaagggtaaagcaaatgtggcaaaatgttaacatttggggaatgtgggaaatgtatatgggaatttgtactattattccaacttttctataagcttaaaagtaagcagtttaaaaaattagaagaggatcaaccaactggaatggggcatgctctagaggaaacaattctaaggccttaacatcgagatgcagtgagctgtgtgggcagccagggctctgggatgtcctaatgaggcaggctcaggaacaaaggatgcagcgtcccagccacactgactggtggggcagagagaggtgaggaacgttggatcagatgccccatccacttacagagatgggccaggatccaaggaggcatggtgagctgggtttggttcagatgggcatccatccaaggagtttcaacgggaaggtgtgatggttaatactgagtgtcaacttgattggattgaaggatgcaatattgatcctgggtgtgtctgtgaaggtgttgcccaaggagattaacatttgagtcagtgaactgggaaaggtagacccacctttaatggggtaggcaacatctaatcagccgccagcgaatataaagcaggcagaaaaacgtgaagaggtgagaccggcctagcctcccagcctacatctttctcccctgctggacacttcctgccctcaaacatcagactccaagttcttcagttttgggactcggactgactctccttgttcctcagcttgcagacagcctactgtgggaccttgtgatcgtgtaagttattacttaataaactcccctttacatatatataaaaaatatatatatgtatttcctattagttctgtccctctaagagaactctgaccagtacagaaggtgaggtggaaaagccaggagaccagtcctgttgctgggggtggaggaaagcatgctcagcagcaccacccccatcctccgactgcacacccaacacgggagcatctcatcaacacagtgatgagtgaagtaagctggacacaaaaggtccttaccataggattctattcatgtgaagctcacatacaggcaaaccaaacagatggtgatgaaggtcatatccatgtccacaggggagtggatattagctgggaagggcaggagggaagttggtgggtcctggaaatgttctatatcttgatctggatgttggtttcagtttattaagatgagcacttacgctttgtgcatatttttctgtatgtgtaaatcctccatttaaaaaggttcggatcgccccacccccaccttggcacagagcactgaaatcacggtcatctaagtgaggcattcacggagattcaatggagacacgatttacgctgttggttatttcattgctaagcaacgcagtctaagctgcacaactaagtgacaccattaacagccagcatggtggggaggggtgggtgtgctaagacaaggatcccagcgtgatggccatggatgattcctgctcccagcccccattttgctgttggaggtgggggctgggggttgggggggcagcgagcagcacagaccaaacagaaggcctggcccctcctggcgtgggctggctgcagtgagcccttcctatgtctgcctgctgcatccatcgctatggcaaccacttccccagcaccggggctaaaatcaggttctgtgggtgtctcggcagtgattggagatctcccctgccatagaattgagtggcctgatgaggagacaaagaagtcactgcagggaaaggccgagactcgctaagcagggccattcctgccaaagttgcacagatttgaggctggcgcacaggcctcagagagagtggtgaaggctgtctgaaggcaggggtgggcaggatgccaaaagaaagacctaaggactggttaaaacgaaaacgatgtggagataaacaaagaccacccaatgagaacaagcaaaggctattcagggcttgctgtagaaaaggaggcggctgccattcctagtgcttggcagagacttgaaggcaggcagaggagtggaaagcttcatagtggaggaggagaggctccaggtgtgccctgagtgaaggctgctggcctggggaagcctcaggtggctcaccagaagcgaggcatccaatgcgactggttaggggagcatgttgggctttctctggtcctaagttggaagcagcaggaaaaagtagggaagccagtggttattgatgatgtcctgactgttctgggcagattgctgtggacgttgtggtttggcttcctggactggctgctgcagattgtgggtcacacttctgctgtcatctatgggctggctgctgtctgtatattctgtctctctatgcagcagttgggcaggtcaagaaagaggtccctaccatctatcaatgaggagatggggccctttgcagtgtagggacacagctgtgagggctaccccaggagaagcaggacatgaagcctcacaggaaggaaggcataacaatgcccttttctgtttggggaatacagacaagaagaaaggtctatacatgtttagtacagatgaaccagtccttgatccacagttggttgaagtcgtggatgcagaacccatgagtacagaggcacaactatatatttaaagagacttatctgttagagagctactcatctgggccttagggagctgacctgatacccattgtaaccacacgcagcacaggagtttgaaactctaggcaagggaggtaagtgaggttaaatatctggctgaactcagaaatctccaaggagccccacatgcttttgtgacacaggccctggggccatttctcaactgcagccactcaggaggtgtgaggcctgggcaactctgcacctgagtgttctccgcctccgccctggcctccttggttggatggtgcttgcattcagcaagtgctccgtccatgctagatactgtaattattttcgagcttctgaataaccggttacaatttcaattaaaaatatttttagaatcaatgtcagtctctgttggtgcagccatgaactaaatgtcagaagcctggactcagagtcggggagggaagtggatggaagggccagcagtagaaacacagcacctgtgggtaccaggggagggtacatgtagtcctgcctcggctatccgccctcccctgactggccgatttcccctagaactctgtgttttgagtgagggaggcgcagttctctaaaagaaaggaagatattattgccaggagaagaaggaaggagaacttaacagacaaacataacatgcacatgcattcaacgtttgtggtcaaatagaagacttaagcctaagggatctagaaattctagttagatcccgaagttacatctaagcagtcataatggtgatcattatgtggcttctccaactgatgttgtaaaaatgattctctcccagtaaagctaggcagtagttcttaatctaactgtagccttcgccttctttgaggacagaaatcaggccttagacttgcctaatctgcttgttttggggatctttcatagtgtattatacagaataatatactcaaatgatgtttgatgataattgtcttgtttcagttcaggctgctatttcagaatatcatagactgagtggcctaaatcctataagaacactcactaatcccatcatggggaccttgtcttcacgacctcatctaaacccaattatctcccaaaggcctcacctcctagtaccagcacattggggattaagattttaacatatgaattttggggggacataaacattcagtccataaaacaataaagacacacgagaagctaacaagagatattcagcgtcagagctcaatggtttccatgaataatggagtgagatataccagataattcctcaaggttctttggattccatgtgtctaagataaaaactcttaggaagagtttcactttggagcaaatatacaatttcaggttagaagtcaaaatatcagatgaaaatgtatgatctctccacaatatctgtgggggattggtttccagaccctgcacccaaaatccatgggtgatcaagttccttatataaaatggtatagaatttgcatgtaacctatacatatcctcctttaaatcatgtctagattacttataatgcctaatacaatgtaaatgttatgtaagttggcgtactatatatctacgtttgtttgtttgagacagggtctcactctgtcgtcccggctggagggctgtggcgcgatcacagctcactgcaacctcgacctcctgggctcaagtgaacctcccacttcagcctcctgagtagccaagactacaggcacacgccaccatgcctggctaaaaaaatttttttggtagagatggggtctatgttgcttaggctggtctcaaactcccgggctcaagcaatcctcctgcctcagcctcccaaagtgctgtgattacaggtgtgagccaccatgcttggcttgtcatactatttcatttagggaatacagacaagaagaaaagtctatacatgtttagtacagatgaacctattcttgatccacaattggttgaatccatggatgcagaacccaagaacagggagggcccgctgtagatttatttatttatttacatagttttgagacagagtctcactctgttgcccaggctggagtgtagtggcacgatgttggctcactgcagcctctgcctctcaggttcaagtgattctcccacctcagcctctcgagtagctgggattacaggtgtgcgccaccatgcccggctaatttttgtatttttttagtagagatgggtttcactatgttggcaaggctggtcttgaactcctgggttccagtgatcctccctcctcaacctccaaaagtgctaggattagaggtgtgagccaccgcacccagccccaactgtatatttaaagagactcatcagttagagagagactcaactgcatcctagggagctgacctaagaatcactgtagccatatgcagcacaggaacctgaaactctaggctcagctgcagccttttcagtgatgaagtcaatgcttaagtctagactagtaatgaataaggtagctgtaagtaagaatagttcatcacccactgctgggtttgcatcctcctccaaataggccctccttatttgcttcctgtggctgctgtagcaaattatcacaaactgggaggcttaaaacaacagaaatttattccctcccagtactggagttgagaagtctgaaatcaaggtgttggcagggccacatttcctgccgaggctctgagaatccattccttgtgtccttcagcttctggtggctgccagcattccttggcctgaagctgcatcattccagtttttgcttgaacccaggaggcaaaggttgcagtgagccgagattatgccactgcactaagaaaaaaaaaagaaaagaattggagattgacacagacataaaaaggaggttttatcttactggaaaaattatgggagaattttgtgataaagagcttagaaggttttgtaaaataaacttatctttataaataacaagaatgtttttaatagcatgaactttcaaatttcagaataattttaaaatttggctgtcctgcttaatgactaagataagaaggaaaggatctgaggacttactccatagaatactcaataaatggtgagacttggcagccaccactttaaccaagtactcaaactcagaatgtgaatcatggcacaacctgactttctggcctccagatgtactgtaatatgaaaaacacataaccggccaggcgaggtggctcacgcctgtaatcccagcactctgggtggccaaggtgggcgaatcacttgaggtctggagttcaagaccagcctggccaacatggtgaaacccctgtctctactaaaatactaaaaatacaaaattacaaaaattagctgggtgtggtagtgtgtgcccataatcccagctgctcgggagggtgaggcaggagaatagcctgaacctgggaggtggaggttgcagtgagccaagatcacaccagtgcactccagcctaggcaacagagcgagactccatctcaaaaaaaaaaaaaaaaaaaaaagagaaaagaaaaatgcataatcatctatcaaatattcttgcaaaaacatgtttaacttgaatcagattaagcctctaagcctacctgctagtttataggaaatacaggggctaaaggaacaagctaatgacaccaagaggaatcagtcagataaatctataatgaaggacattcattgcatgaaacaattgttctatggtcttccaaaaggcattgtcattggaaaacaaaaagtactaggaccattctagactaaaggagatggactatcgagaccaaaccagtggcaataagggaaaccagattggacccttgttaaacaaacaaaattataaaggtcatgtttgggacaattagagaaactttagagtctatatattattatggtgtggaaatcattttcaaggagattattctaaccttaggagatacatgctaaagtatttaggggcaaagatgttcaaatatatatactttggcgaggctcggtggcttgtgcctgtaatcccagcactttgggaggccaaggtaggaggatcacttgacctgaaaagtttgagatcagcctagctaacatggtgaaaccccatctctactaaaagtacaaacattagctgggtgtggtggtgcacatctgtaatcccagctacttgggagactgaggcaccagaagtacttgagcccaggaggcggaggtgacagtgggctgagatcgcaccattgcactccagcctgggtgacagagtgaaactgtctaaaaacaaaacaaaactatatgtatatacatatttttggaactgtatatataatatacgtatattatatataatatatatagttcctttctgtatcattggaaatatataatatatgttatatatataacatataacatatataatatatatataaaacatataacatatataatatattatatataacatataacatatataatatattatatataacatataacatatataatatattatatataacatataacatatataatatattatatataacatataacatatataatatattatatataatatatggtatatatttccatatattatatataataaatatatattatgtataacatatataataaatatatattatgtataacatatataataaatatatattatgtataacatatataataaatatatattatgtataacatatataataaatatatattatgtataacatatataataaatatatattatgtataacatatataataaatatatattatgtataacatatataataaatatatattatgtataacatatataataaatatatattatgtataacatatataataaatatatattatgtataacatataataaatatatattatgtataacatataataaatatatattatgtataacatatataataaatatatattatgtataacatatataataaatatatattatgtataacatatataataaatatatattatgtataacatatataattaatatatattatgtataacatatataattaatatatattatgtataacatatataattaatatatattatgtataacatatataattaatatatattatgtataacatatataattaatatatattatgtataacatatataattgatatatattatgtataacatatataattgatatatattatgtataacatatataattgatatatattatgtataacatatataattaatatatataacatatattatgtataacatatataattaatatatataacatattatgtataacatatataattaatatatataacatatattatgtataacatataattaatatatataacatatattatgtataacatatataattaatatatataacatatattatgtataacatatataacatatattatgtataacatatataacatatattatgtataacatatataacatatattatgtataacatatataacatatattatgtataacatatataacatatattatgtataacatatataacatatattatgtataacatatagtatatatattatgtataacatatagtatatatattatgtataacatatagtatatatattatgtataatatatatattacattatgtataatatatatattacattatgtataatatatatgttacattatgtataatatatattatattatgtataatatatatattatattatgtataatatatataatattatgtattttatatattatattatgtataatatatatattatgtataatatatataatattatgtattttatatattatattatgtataatatatatattatgtataatatatataatatgtataatatatatattatgtataatatatatattatgcataatatatattatgtataatatataatattatgcataatatatattatgtataatatataatattatgtataatatatattatacataatatataaaatatattatgtataatatatattatgtataatatataaaatatgttatatataatatataaaatgttatgtataatatataaaatgttatgtataatatataaaatatatgtaatgtatattatgtataatatatgtaatgtatattatgtataatatataatgtatattatgtataatatatatcataaacatgtatcttatgtataatatatatcataaacatgtatcttatgtataatatatatcataaacatacattatgtataatatatatcataaacatacattatgtataatacatatcataaatatgtataatacatatcataaatattatgtatgatacatatcataaatattatgtatgatacatatcataaatattatgtatgatacatatcataaatattatgtatgatacatatcataaatattatgtatgatacatatcataaatattatgtatgatacatatcataaatattatgtatgatacatatcataaatattatgtatgatacatatcataaatattatgtatgatacatatcataaatattatgtatgatacatatcataaatattatgtatgatacatatcataaatattatgtatgatacatatcataaatatatattatgtatgatacatatcataaatatatattatgtatgatacatataaatatatattatgtatgatacatatcataaatatatattatgtatgatatatatcataaatatatattatgtatgatatatatcatacatatatattatgtatgatatataccatacatatatattatgtatgatatataccataaatatatatatgtatgatatataccataaatatatattatgtataatatagtatatattagatataattatacataatatatgtaatcatacataatatattatatattatatataataattatatataatatacataatatattatatgtaatcatacatattatatattatatataataattatatatattatacataatataatgtataatatatataattatacataatatattatatataatatataataattatatataattatacatattatgtattatatttaataattatatataatcatacataatatataatatgtataattatatataacataaaatatataatatgtataattatatataacataaaatatataattatatataacataaaatatataattatatataacaaaatataaaatatgttatatatattatacataatatacaatatataaaaatataatatcaaatatataatatatatatttccaaatgatacagaaaggaatgatatcattaaaataaatatggctaaatattaacaattgttgaatctaggttgggcatgcaggtgttcattatatgaatcctttaacttttctgaatatttcaaaatgtttataacaaaagtttggagaaaagaacaactggtcttcaaggccttcattttagtgacaatctgggttaaattgtaagtaatttttatgtgaatattgtataagaaatacatggtgctctattttgattatttgatttaactcggtgtatatcactgttgagcatatctgcatgaagtactgaaaatgaattcattataaccaagaaatcccgatgtaagagcatagacacactaaccctaatgtatgtttgttactggattgatttttcagctatggtatgaatttgtcttttcctaagaaaagcattcacacacatgttgctatttcagtgacataaagtatctcctggaaaatcatacattactcattcagccaaaatttagtgacaccctactatgtgtcaagccctgtgttggccttagggatacatcagtacatgaaatgaggcctctgccattgggaagccacaggccgcagactctcacatgcctaaggacagccgtgcccttgcccatggaaaagtgcagggttctctgaagattttgcttgcatgtaacctaaaaattatgcattgcatatcctcatttcttgatgaatacaattttatattttatgtttaaatggtggcaaaagatgtaattccagtttaaaaattgagattttaaaataaaattgtttcattactcttttttaaatagtcatagtgtagtagctttataatctgtgtttgctaacttccatacctgaggtctttgtggatggtttctgctacctgttgtgtgttagttcttgtgctacgtgtgtgttgtcacacacacacacacacacacacacacacacatctatctgtcaaagaatctccacaaataaatttctagggacaatgagtagcacacaggtatattcttccacagagaatttgtgtttgcttttgccaggtgcttagggggtcccagcagtccaagattacatcaaactaaactcactgcttaagattattggatcactagggtatgaatttggggtacagtctatgccagggctgattcatggccataacttttctggaacttttaaaaaataaggctcagataagtttcctaaaagtctccaggagaagtcagatttacttggttcaccattcccctgagagagcagctgtgtgggtcttgggcgaggctcctggtggaaggtctcttaacagatgccttcccttgggcaggctctgggctttgacagtcgtcctttttgctgctagaaactgtcaaatagaagttcaagtttgcctggttcagcaaaacaaaagcagccttcatgttccatttactttttggtattctctcttgtccttagattttggcctggtaggccaggcatggtggctcatgcctgtaatccagcactttgggaggctgaggcggacggatcactggaggtcaggagtttgagaccagcttggccaacatggtgaaaccctgtctccacaaaaattcaaagattagtcaggagtggtggcacatgcctgtaatcccagccactcaggaggctgaggcgggagaattgcttgaacccagaaggcagaagttgcagtgagcagagatcacaccactccagccttggcagcagagtgagggagactctgtctcaaaaaaaaaaaaaaaaaaatttttggcctggtagttaccttactatttttgtcaggcgttcagtgcttttaggaatctgttttctatattttatatagaatttccaattgttggtctaaaaaacccagtctgccatagtcttagaaagggaagcgaacatcaccacttttctcagtactttaaatgagaggttcttttaacctaggattcatgcatggagttcaaggcatctatatacccccctgaaatttcatgcaatgttttgtgtttaaccaattttttctgggaacaaaatccatagatgttatcagattgttaaaggtgccagtgatagagacaccctcaaatttgataactattgctttagagttctatcagtacctagtaattttaattaaaaaatgattttagaatgatttcaaactcacagaaaagttccaagtagagtgcaagacaatctccacattgtcgtcacccagattcgccaatgttaactctgccctgaccccacacacaattagtctttttctgaaccatttgggaacaagcttcagacctgagtccacgttacccctaaatgctatagtgggtatttccccaaacaaggatcttccaaatcaagaagttaacatcgctacaagaccgttcacagaatctatataagtttcaatttttcaatttcaactgtcccaagaatatattttttaaaaaattggactgggtgcagtggctcatgcctgtaatcccagcactttgggaggccgaggcgggtggatcacgaggttaggagttcaagaccagcctggccaagatagtgaaaccccatctctactaaaaatacaaaaattagccaagcatggtggtgggcacctgtaatcccagctactcaggaggctgaggcagagaattgctagaacccaggaggcagaggttgcaatgagctgagatcacgccactgcactccagcctgggcaacacagcaagactctgtctcaaaaaaaaaaaaaagtgtgtaatatttacttcacaggattgctatggatgttcattggacataataaggagtttggttagttgtcattgttagtttgttacagttacactgtgtccccctacacttcccctcttactcattgcttattggggtatggaaagccagcattgctatagcattctcgcagcacagtacacacacacacacacacacacacacacacacacacgaggctggaatcatgggtatactatgtctttaataaaggatctttcttggccaggcacagtggctcacacctgcaatcccagcactttgggcggccatggtgggcggattgcttgagcccaggagttcaagaccagcctgggcaacatggtgaaaccccatctataccaaaaacaaacaaacaaaaaaacaaaccacaaaaattagctgggcgtcatatgcctgtagtcccagctacttgatactcgggaagctgaggtgggaggatcacttaagccagggtggtggactgttgcaatgagccaagatcatgccactgcactccagcctcggtaacaatgtttcaaaaaaaaaaaaagtatttttcttgattggacaatgagaattctaattgtaatggatatctattgtttggtcctcccccttcttgtgggaaacggtctttctctacttccacaaggtagtgtacattgttcttacctgaaatggcagttacaagaacatgacaatgtccatgttcttaaagatcctagatctttggcacaatcatttgattcacggacaggcaactagctggaccaatgaactagccttccctgagaatttttaacttgggactagagatcatcatccttacctcgcctgtctgatgatgaggcagaagatgaaatgttgggagctgtcagtggccttgtttccagacatatggaggaagctggtctaacagcatgaagccaatgtgcagagagagttgcagagctgagccataggggcagaggcattctcgttctagtagtcccagcagtccctccccttcttggagtctgtccatatcaacagtacattcctcccttctgcctaacagttgagttcctgtcaatggcaaccaagagaggtgtgactgattcatgtattcaaagggctgttgtgagaacttgtgcctgactcacagtggggactcaacaaatgttggtttattactcttatatttaacgcctaaagtctgaatgcgaaaaggttagggcaattccagaaggaattactatgcagaagggaaaactggttgacaggttaactttcctttgaacatcacaagggaaggcacctaaatacaaaaggaaggcttcctccacgccccccatacacacacattcccttcatcctaacctggctctgcagctccgagggtcacatacctgcccttggcactactagtacttcctccagcaagtctcagtctttctttcagaatccttcgcccttatgccatgtaacatctgatcggcccggtctttgcccctagtatcagcaggccaatacgtgctctgctacaggtcttacagggagggtgagctcttggagttggatcagaaggagaggggctggggaaagatcgtcttcaaattgtttctttggcggtagtatatataaacatatttaggcagggcatagtggcacatgtctgtaaccccagcactttgggaggccgaagcgtgaggatcgcttaaagacaggagttgaaaatcatactggtcaatatagtgagattgcagtgagccattatcgcgccactgcattcctgcctgggtgacagtgcgagaccccttctcaaaaaaaaaaaaaaaaaaagaaagaaaaaaatcataagcaaacaacaacaaaaaaacaaatataaagaatggcggtctgcttaattctccgtgccagcccttgaaatcagtgggtattattatgtagagtttgagttctttcctcccttgagtaacatgagtgacatcagtaacattagtcaagcgctgctctttttgaaagactgtatttcattatttttattctaaaccttactctgtttgatgaagattgggggaagagccctcccaattccaccgctcacacataacagcggttgctagcattctttatttgtgctaggtcatctgcatattgtttaaacatttttcgaggctggaaagactgctcccactcaggcaattctgacgtggcggcccttctaatttatattctctaaataattcttcatttagagaaaacagtcagggattacagtgagggagggtgacgtgctgacggggacagagcttggcttttgatcattctccccttagctctgcccaggcaagcgtccctaactcagggtatcggaaccgatctcccttagaggattatgtttcaaccaccagcctcagcggtttactcaaatgtccttccagccaaatgcagaagtctccctgggagtaattttggtgaagtcagcttttgcctttttcatcacaggcaggctttagtagttcctcaaaacgtgcaccacaactgcccggctgccaaacagaaatgctgatgcctgggcccactctagccatttggcctcggcatcacggtgcgggagcgtggggcgcagactcgcattgtcacaggaacctcccggccttccgaagagccccgcgccggggcctttgtctcgcacgtcggctggggcgggagctaggttctcgcagcctcctcccaccgctctgcgccttctttgtccctccagaagccgccatcaaagctcagctcctgattaggtttcggccccgctggccggcgcagtctcggcgactaccccaggcggcctggcgcacgcgaggattcgccgcgccccagatgcaggtgcctcccctccttagccgccgaccgacagtgcacgccgcggccgccggaagtgacagcgcctgtcgttggggagctcccgccccttccgcctcggcgccccgcccaggcctcgcccctaggtgttcccgcccctccccctcccgtgtcgctcgctttctgtcagcctctctccctctccctctcccctctccttcctctcgcttcctctctcgcacctgagcgtacgcacctgcccgggcccggctccctcctcctctcccctccctctttccccgcccggccgcgggagcctcgtggctgcgtcaccgccgcccccccagacaagatggacaccgcggaggaaggtaagtcggcgacgcgcggcgcccgagcccttgcgtcggcgcccgggttcgtaccccggccaggtccgcggcgctcgaggtgggctgctggatcgcggcggggcggacgcctgggccgtttgtccacccgctgggcctctgggccggggagcggaaggtgaccctctgcgcgccccccgccgtttcccgcccgcgccgccgaggggggcggggaccctgccgggcaggggccggggccggggtcggggcctcggggctactgcaggccggcgtggcctcccttgtccccgccgtcgcgcgctggcccagaaaagggggcctctgtcgctgccgtccgggggcgttttccgcacccttcccccactgggttttgtctttctttacgtccttctgcctattgctcgccaggccctaccccctcgcgacagaacttctttgttgactttgaaacttcgcgaaaaataccccgccagatgacggccgagtggagtgagctgacccctgttgaaaagcctggtcctcggcttgcctgccgctcgagaatctgtttactaaacggggaggctcttttgttgcgatccatttggttttaaatccttgacacctataagcagggttctgtttgttttgttttgcgattgcttgtgttttggatacggttacattgaacaaactgacccttgtaaaatgaatacttaagatataaacgtccacaccttatgtctcttcaaacgcattttcttacccactgaaggtagtagattatttttaaccagctgtgtttttaaatgagtggtgagtttatagaggaaattactaaattttgctttttttgatgttccggttatcgtgcaaatgcttttctactttaggtatatttatgggggtatgagcgtctttcaaccttatgggttgcgattttggcgattttaaacgaaaatgaattatcaaacgccgtcatggagtgcaataatgagtgaaaaaagtttgatattatctatgtaatgagttgataacgacttatttttttttaaagaagtcttgcctttaataaatacctcaactataacatgtggcacttgatgtacattcgcgttccatcttcgtaaaaagcctgtggaataggtaggtattatcttttatagatgtggaaatgtaggcttcgttattttaatagcttgtcgaagctttacacaggtagtaagaggcagatttgaacctaggcattctgattgcaagtaatttccctttcattatgccacagtgtgtttattatatacactgagtgtagctaatcgccactggagacgcctttggaaaaaatagtaaagcgaaactgctgaaggttgcgaactatttctttttgacaggtggtccttgcgtgtaaatttccatctacataggtttcacatccttttagattcaggttttaatgagtaaatctagtaaggcatgtatttatcacaggataggtacggacgtattacattcaattctcattcttttggcctgggcattgctacttgcatacttttatggtgtgacagtaatctgtggtaattcaggaattgcgctcgaagcacgtatggaatcatgaaatattttcactgtacttctagtgcttaaatatattttttctcttgtaaaattataatcaggataaggtatacataacatttatttattgaacactgttgcctgttaaaataacatgtgctgaagactcaacgtgtagtatgtgctttactaaacactttatatacatttcatttaattctctcacatcgttaggtagtcggcattttcattttacagatgaggaaactgatggttagtatgattaagtaacttgtccaggataatacaggtagtaaatggcagaggcaagattcagactcatgtctgtcagagtcgcacttaaattagattatttatttatgagtgtatactacaagtccaatgttgaaatttatttttgtcactccctctataggatgaatcatttatataatttggtggaaactttattttgctttattttgttttatgaaattattagtcatgaaatgcaagtgaattttagtgccgtattctcatgcctgcttttgcaaaattccagtttggaagtcttctgacatttttacaattaaatttaagttgaaataacacttaaaggaaaagggagggttatagaggattaaaaatgatatagcaaagatgccaaaaaactaataaaaaatgttctatttgtgaaatcagttattataggttatttctttaaaaaatgcgacttaggttttttaaatctgcttagaaattttttggtaggagatattcaaagtatggccaaacataaaactaaattaaaaaaaaatcagtatcacctacttttgaaaacacttatactgttgtggttctgttttttatttattttattttattttattttattttattttattttattttattttattttattttattttattttccgagatggagtcttgccctgttgcccaggctgaagtgcagtggcatgatctctgctcactgcaacctccacctcccaggttcaagcgattctcctgtctcagcctcctgagtagctgggattacaggagcgcgccacctccctctgctaatttttgtgtttttagtagagatggggtttcgccatgttggccagactggtctcaaactcctgacctcaggtgatctgtccgcctcaacctcccaaaatgctgggattacgagcgtgagctaccgttcctggccggttctctgtcctttaaaaatatattttaatattctgagcaaagagattaagaatgttacaaacacatcaaccgtgcgtatagtaagtcttcccttccttttaaaaatagcacattgcttgcctctgatggtaccatatatgatagtctgatgctcagaatgttatgcatttgtagtaatacttagttccgacatggctgtttcatactaattgtttgctagattttaaagatctctaaagtttcttcagtattaaattaatttttgtaaaatcaacaggtttataatccattctcataatacagggatggataaatcattcttactgtgtatatgttatttgtatgagtgcagatgtgttatgtcaactgctatccatcctgacatttttaaacttcagagctataggagaccttagacatttgccctcctcattttatgggttaggagtccgatcctgtaatgcactgagatttctcagtttcagagaaaagtctatcctttggtcaaggatatacttttttttttttttttttaaaggaaaagcagtacaatattggaatagatgttgcaagtgttgatgtgcagttctcaaagataatattaaacattttgtcatagaatgcccacatttcggctcagtgatataaagctgaggtttttttttttttcttttccattttgctaaattactgcttgtattagcacaacataatacaaagtcttagtaattttattacagaataccaaagcagctgttctttatgctttacggaacatattcattcgaaaagtgtgaagctaaagagtattatggttgatcatgttctatatcactatggcaaaaatttgaggtaacttaaatttggaagaaatgagttaaaaggatagaaagttgtcagaatcagacagctagttcctctctttctagacccacacagtcttctttgtttccagagatgtctgctgcatgtttcttaccacgcattacctttcactgttttggcatgcttgtgaccaagtgtacatgcatttattcgttaaatgtttactgaggacctgttatgagccaggcactattctatgcatttgggctaggcaaggaacaatatagagaaaatcctttctttcatagagcttacattatagttattagcttaagacaaaataaacatgtaaattatatggcataactagaaggttataaacgctgtggagaacagtgaattgggagggaataagaagtgccaggatatgagggcatgggttgctttttttttttttttttttgagacggagtcttgctctgtcacccaggctggagtgcagtggcgcgatcttggctcactaggggtcgcagttttaaatatagcagtaaaggaaggcctcactgagaaggagcaaaggagaaggagttagccatgcagatactctgggcagagcattccaggcagagggaacatagcctatgtgaagtgtctaagatgggagcatgcctagagtgttcaataaatcaccaggagagcagtgtagctgtaacggagtaaaagagttggagaagagtaagtataatatgaggtcagaaagatatggagccaatggggagagagcatgtaggacttcattgacttttatagtgagatagggagctatgggagggttttgagctgacgtgagacataaattgtcttgatatgcagccagctttctgtatttgtgggtttcgcatctgtggattcatccaatgtcagatggaaaatacttggaaaaaaatagatgattacctctgtactgaacatgtacagcctttttttcttgtcattattcctcaaacaatacagtatgatgactacataacatttatgttataattattctaagtaatctagagataatttaaagtacagttgactcttgaacaacatgggtttttgaactacatgggtccacttacacatggatttttttcttcaataaatatattgaaaaaaattttggagatttgcagcaatttgaaaaaacttgcagatgaactgtgtagtctagaaatagtgagaaagttaaaaagttatgtcattaatgcataaaatatatgtagatactagtcttttactcactatcataaaatatatacaaatctgtcatgaaatgttaaaatttatcaaaacttacacacacaaacatgtaatggagactgtacatggcaccattcacagttgagagatgtaaagaaacttaaagatacagtattaaatcataactgcatgaaattaaccgtagtgcatactgtgctactgtaataattttgtggccaccttccgttgctgttgttgtgagctcaagtgttgctgttgttggagctcatctctccagtaaattgtatatggtaaaaagtatctctctggattctcttgtatttttcattgcatttagtgcagtaccctaaactttgaataacatgatgggatccatatgaggtgccactaagtgatgctggaagtgctccaggaagctgaaaaaaggcatgacattatgaagaaaaagtcgaattgcttcatatgtgccatagattgaggtttgtagctgtggttgctggccatttcagaatgatttatcttgtaaacagacaggtatcaataaatatggtacagtgctgtaaatgtaatttccttctgattttcttaatttttttctctagctttattgtaaaaataaagtatataatatagaatacagtatataatattacaatacatattgtaagaatgcagcatataatacagtacgcaatacatataatacagtttatgcattcatggcataattttattttttttgctccttctaagctacacagttcatctttttttaaattgttgtgaatttccaaaaaattctccaatatatttattgaagaaagaaatccgcgtataagtggacccatgtagttcaaactgtgatgttcacagatctgtactttaaataatctcctgagtactcataatacctagtataatgtaatacaaaggctgggtgcggtggctcacgcctgtaatcccagcactttcggaggcggtggcaggcagatcacctgaggtcaggagttcgagaccagcctggacaacatggcgaaaccctgtctctactaaaaatagaaaaaattagctggatgtggtggcgggtgcctgtaatcccagctccttgggaggctgagacaggagaatggcgtgaacgtgggaggcggagcttgcagtcagccgagatcgcgccactgcactccagcctgggcaacagagcaagactccgtctcaaaaaaaaagtagtacaatatgtgtattaatctactgtttatgttgtattatgttatgggaaggcttctggtcaccagtaggctgttagtagttttccattagtagtttttcgggagtcaaaagttgtatgtgtgtgtgttttttttttttttttttttttgagacagagttttgctctttttgcccaggctagagtacagtggcaccatctcagctcattgcaacctccgcctcccaggttcaagcgattctcctgcctcagcctcccgagtagctgggattacaggcatgcaccaccatgcctggctaattttgtatttttcgtagagatggggtttcatcatattggcttgaactcctgacctcaggtgatccatctgcctcagcctcccaaagtgctgggattataggcgtgagccaccgcgcccggctgtatgtggatttttgattgtgcaggaggtcggtgcccctaactcttgttcaggggactcctgtatatggaaggatgtgcataggttacttggaaatactatgctgttttacataagggacttgagcatctgtggattttggcacctgtggacttcctgaaaccaatcccccagggttactgagtctatctctttcctggttaagacaagtttttgtttgtcttaaattcaaatttctggaagctacaatctcactggctcatcttgggtcagttgcttatccttttgatccaggtagctgggtggtggtgggaaaggtaatggaagaataagaatcatgactggctgtgtccattcttgagctggtaagacagtgcaaaagagatctgctatattgctcaattagaatactttttagactgaagccctgtgagtgattattgctgggctatcctcttccagatgcctacttcccatttcttccaggccaggcttactttagtgggttttacttctgtcctgtaagactatgaagatcacttatttttagtataatacagttagaacagaaagagttcttgaaaagtgaataggaagtaagaaccccccaagggaaaacttaataattcagactatattttagaatgctgttgcagtaggctagatgagatataggagttacattaaggtagagggaatggaaagaatggaaaagaagaaatagaccaaggtagaattaatagaacatagtaattgaagaggtaatataaggaggaggagttaaaaatgattgatttttatattatttcaaatgggaatggaaagagataagtagttcagttttagatattgttttagtttgcaggggctgctgtaacaaagtactacagattgggtgcttaagagaaatttgttttctcaactctggaggctagaagtttgagatgaaggtgttggtaggcctggtttcttctgaggtctctctccttggcttgtagatgattgtcttctgtgtcttcatgtagtcttctctctgtatgtcttcatgtagttgtccctctatgtcctaatctcttctttttttaaagacgctagtcatattggattagggcctactctaaggacctcattttaacttaattacctctttaaagatcctgtctccaaatatagttacattgtgtatacatgcaggttagggcttcaacacgtgaattacggggggaggggcagtgcaattcagcccatgatagacatgaattcttgaaggcttggaagactgaagcattccctgtacacttattttttataacttaacttcattataatatctttttttttttgagacggagtttagctcttgttgcctaggctgcagtgcaatggcgcgatctcggctcatggcaacctccgcctcctggattcaagggattctcctgcctcagcctcccgagtagctgggattacaggcatgcaccaccacacctggctaattttgtatttttagtagagatggggtttctccatgttggtcaggctggtcttgaactcctgacctcaggtgatccgcccacctcggcctcccaaagtgctgggattacaggtgtgagccactgtgcctggctgtaatacactttttactttcctgtctctctccttcccttctgtcacctcttaatgtattctgtaaagatggaatcaggttaataaagtataatttacacacaaatttaccctgtttagggtgcagttctgttataacacttttgaaatagaatattggagattccatgtcttttttgattacttccccatttaccaaatattgggtacatgtctactacgtatctaggacctgtgcaacaatgttttctgcatgtttcatttcttcattccaagtccttgaaaagtgccaagaggcatttctattgaatggaacagtttgaagagcattgatgtagctagagtagtggttttcaaagctttgtcccaagacccctttacattcttaaaattgaggacccaaaggacttttgtttatgtgggttttatatgtaaagatagatatttaccatattagaaatgaagaatgaatacaaattatttagaatatttaaaagtaacaataaactcaatatatgttaataaaaataacgttatctggattattataagacaattggattctcatctctccctttgcagtcactttgttaagtgttttggttagtgtatataaaaactcggcatcacacagatttatagcttgaaaagggatgaatattttcagatgtttgtatgttctttgatactatgtcaaaacttgacaagtggtagtttcttaacgtatctgaaaacatggcagtcaccttaaaaaattaaattaactgttaaattaaaatccatttgtctggtagtgtaggatagagtccagaaatagatccacacatacatggacagttgatttttggacagaagtgcaaaagcaattgcataaaatataaaggatatcgtttttcaacaaatggcactggaatagttgaatagctgtaggaaaaaaaaaagaactttgagctatagcttgtaccatataccaaaattaactcaaagggctgttagacctcaatgaaaaacctaaaactatgaaacttctaggggaaaatataggagaaattcttcggaatcttgggttagaccaagatctcttaggtatgactccaaaagcatgatccataaaagaagtggataaatcagatggcatcaaaattcagaatttctttcaaaattagaaagacacttaacagaatgaagacaggatacagaagatgtatcttataaggggcttggagtatataaaaaattctcagaactcagtaataagaaaacaataactcagtttttaaaatggtccaaagatttgtatagacacttcactaaaaaatacatgtacatggctattaagcatatgcaaatatgctaagcatcattagtcaaaaccataatgagacaccacttcacacctgctaggatggctataatcagaaagaacaggtaagtgttggtgagcattgtagaaaaattggaaccttcatttgttacgctaggaatgtaagatagtgtgactgattttggtaattcctcaaaaagataagctgagtaaccatatgacccagaaatttcatatacccaagagaattcaaaaaatatattcacacaaaaacctgtatatgagttagcagtattatttataatagccaaatagaaacaacccagtgtccatcaactgatgagtagataaatgtgatctatttgtaaaatagaatattacccagcagttcaaaggaattaagtactgatgcatggtacaacttggataaatctcataaacattaggataagtgaaataagccagtcacaaaagaacatattttctatgatcctatttgtgtgaaatgtccagaataggcaaatctatatatagagaaattagtggttgtctggaactggggagagcagatggagtaggaagtatccactaatagttacagggtttccttttgggatgatgataatgttctaaaagattatggtgatggttgcgtaactgtaaatatacttaaaacaattgaagtctttaaattggtgaactttatgacatatatctgaataaaattgttaattaaaactactgtgagatatcattacatacctattagtgtggctaaaatggtaatagaatgactgaccgtaccaagtgtttgtaaggaggtagagcagttggaattttcatatactgctggtgggagtgtaaagtggtacaccacttcttctggggagcagaaagcaaccttccgggtacaggtgagccaaggttgatgggcagttatgcagagggagttgggatatcactgtgtgtacctgtgcaagtcctggagtgtgttgggtcctcatcagcagggctgtatgaaggtgttcattaaaacaaaactactgatagtgtggcaggagctagaaaacacccctttcttcttagatatccctccagcaccctctactggcaaagtttaactgcccctagccaaaagaaaagaaaagaaaagcttagcatccctatcactgaacagggactgaaagggagaatttggagttgagaaggggatacatggataactagctcattactgctgaaattgttggaatcattcattgcctgtgctgctgaagcttgatgttgcccacagctgttgggcagaatctccaccatgacttgcgtatctgttagcaggagtctgcagtacctgccattagctgcaactgctggtttttagaaacaagtagaaaatggtttcgctgtttctctgcttcttctttatttttatttttgagatggagtttcgctcttgtcgcccaggctggagtgcaatggtgcgatcttggctgactgcaacctctgccacccaggttcaagcgattctcctgcctcagcctcctgagtagctgggattacaagcacatgccaccacgcccggctaattttgtatttttagtagagacggggtttcaccatgttggccaagctggtcttgaactcctgacctcagttgatctacccacctcagcctcccaaagtgctgagattacaggtgtgagccactgcacccagcctccctgcttcttctgatctcacagaagtgcttctcattgacagactctaacttaagcctagttggcaaggaggccagaaagtgcagttttcaggcttccaggagcaacagtacaggtgaatttttaatttagtaacgatagtaatctggtgagctaaaataagtaaactttggggtacatagagaattggaattattattattattattatttttgagacagagtttcgctcttgttgcccaggctggagtacaatggcacgatcttggctcaccgcaacctccgcctcccgggttcaagcgattctcctgcctcagcctcccgagtagctgggattacaggcatatgccaccacacctggctaattttgtatttttagtagaggtggggtttctccatgttggtcaggttggtcatgaactgccgacctcaggtgatccgcccacctcagcctcctgggattacaggcgtgagccactgcacctggccgagaattggaatttttaaactgtgtttgcaaggcctaattcccaaacccacatagtttgtgtatgggtatacgctcaccctcaaaaaggaaatattttttgtaaaatttgagcagttaaacatttttttctgcctgtaattgtaaaagtagcaattaaacactatctacttggggacgagaaaggaagaaaaattacccatgttctcgtctgaccaattacagtggctgtcttttttttgcattttcttctttaggctatggtgtttttacctagttggaagtaagggagtgtggtcatttaaaaatgttatatctctttccatattagcaaatagttatatatacatatatatactttttttttgttttttggtctgttgcccaggctggaatgcagtcacgcaatttcggttcactgcaacctccgcctcctgggttgaaatgattcttgtacctcagcctcctgagtagctgggattataggcgtgtgctgccatacctggctagtttttgtatttttagtagagatgggtttcgccatgttggccaggctggtttcgaacttctggactcaagtgatccatcttgccaaagtgctgggattacaggcatgagccactgcgcccagccttgtatttgctatttttaagggactgtatacattccatatagtgaatgtgcaccatttatatagccgcttccctattttgggctatataggttatctgcagacattttgagtaatatttttaatatattttcaaaattgtctactataattgtagctactaattgtaaaaattttattgataattacatattaaacattccttgtttacttcagccagatgaacaaggtcaacattaacagttacatgtggcatagtgccacggttattacttgagactgtcactatgacagttactgctgttactacttgagaccgtcattatgagactgagtgaagggggacaaatgtagaaatgaaaaattaagacaaaagaaacttttaaaggaagaaaaaaggggaagaaaaagagggctccctgcttctagggagcaaaggcagcagcctagcttccacagcccttagaatttattgggtagaaagagcaggggggaggtgataatgactggtcagctgcttaattgatcacacgttcatattattacgaacaggcttcagatgtacctaatcacaagaaactgagcttggggcgtgactgccttcagcattccttctgggtggcataggcagtttgtcagtttgccaacattctgcgtttatgagaacagtttgctgttcactcttatagcctccagtggtatactgagttgatcacgaccctcagtctttcggcctccaacagttacaaatcatgttgatggcatatcccttgatatgatatgatatgatataagatgccacttcatgtgatttttttccttcccaaaacccatagccccagtctattcatgaatcatgcaatttccagtaaacagacattctacagtgtacctgaccagtactccttaaaattgtcaaggtcgtcagaaacaaggaaaatctgagagactgcccgagcccagaggagcccaaggagacatgacaactaaatatatgtagatcctagaacagaaaagggacgttaggtaaagactaaggaaatcagaataaaccatggatttgagttaatgacaatgtatcaatattggttaagtgtaacaaaagtgtaacaaatcctaataagatgttaatagtaggggatattgtgtgctgggtatatgggaactctgtactctcttcatattttctgtaagtctaagacttctaaaatctaaagtctgttagtaataaaaaataattctttgtatattaaattatcactgatttaacaccagaaggtaagtggagagattttgaagtcttacatcaaagaactttcaagatagataatagcttaagagttataacatgtaccccaaaacttagagttttatttttttcctcatactaggcacttaggataaattattgaactgtactgttggctagaaaaactttgatgaaatgggctgacttccacagtggtggtggttttctttctttctttcccatctcctgggcaatctccacaagaatttgaaaaattactaaggacttgaagcttttttttaattaaaaaaaccactattgtttattgagccaagctctttggtggaatctttaaaaggtatccatgtgtaaagacattaggtattcaaatacagcaacaaaaattgctacaggattaaatagaaatttccctttgaaaaccaggaagagctttgccatattgtttctaagtaggtttgcgttcataacaagcaagatgcattgattttactttggcctgagcaagattcataattttactgcatacgaatctgatgggggggagcctcaatctgccacagaacctacttcggtggtttaatttttagtaaaggactttaagctgagccctttgtagacttcactctttttgtagccttggccttgttactctgttgaggttttgggtggtgggattggaactagtatacaaaacaggctattctttttttgactttgtatgtttgtaatagtcgtacttgcttcatgtttttgcaaagctgctaagattctgtataaaataggatcagctaagttatgtcgtagtcacaaactaccctaaacctcaggagcttaaagcatcaaaaggttaatcacttcttggccaggcacattggctcacacctataatactggcagtttgggaggccaacaccagaggattgcttgagcccaggagtttgagaccagactgggcaacgtggtgatagagagaccctgcctctacaaaaaataaagaaaaatttagctgggcctggtggtgtgcacatgtagtcccagctgggaggctgaggcaggaggatcacttaagcccaggagtgttttttgtttgtttgtttctttttgagatagagtcttgctccgttggttgcccaggcttgagtgcagtggcgtcatctcggtttgctgcaacctccacctcccaggttcaagcgattttcctgcctctgcctcgcaagtagctggtactacaggtgtgcgccaccacgttctcggtaatttttagtagagatggtgtttcaccatgttggccaggctggtctcaaactcctgatctcaagcagtctgcccaccatggcctcccaaagtgttgggattacaggcgtgagccaccgtgcccagccaggagtttgaggctgcagtgaactatggttgtgccattgcactccagccttgatggcctggatgacaaagtaaggctctgtttctttaaaaaaaaaaaaaaaatttccaatgtgggtggagggggaagtgcttttgctaactgtagtcactggggagcccagcttgatggaagctccatcccttactgcatgcttccacgcccattgaggcagggaaaatgcagtgtgatgaattgtgttcattggctttcagacacttctaccaagaagggatacttgtcattgtacctcatatttcattgaccaaagtaagttacatgtccatgcctaatttcagaggtggcagggaagtgcagtttcagtgtatgcccagaaagtggaaagtgagaaatatttgatgaccaatgctgatgatttccagtccctaacaacatcagtttctacctggttggatgaaaaacgtgtgctcattgggtgtacacttcaatctacaatttcattagatgacattttagagagggaacaagtatgtttttcatgtcatccttctttcttatttgttctttcttcccacatgtctgtgtagacagtactgtagaaggcctgtcgatttcatttttcaaattaaagtataatttaaatacagtaaaatttaccttatttaatatctattttgacaaatacatgcagtcatatagccagcacagtcaaggtatagaatagttccattacccccccccccccttgcaaatatcctttacccttttatggtcaactttgtcccccatttccagcccctggcaactactgatctgtttctgtccctatcattctgctttttccagaatgtcataaatagaaccatacagtatgtagtcttttgagtctggtttctttaacttaatacaatgtttgagggttatccacatcatcgttgcatgtatcactagttcatttctttttattgcttagtattttattgtagggatgtaccaaagtttatctattacccagttgtggaattcttgagttgattgtttctagttttggggaattaaggatgaaaccgttatacatactcacataggtttttgtgtgaacataagtttttgttttatcaggttaaatatatattagtaggatttctggattgtctggtaagggtgtttttattttcatttttttgccctttcaataggtatgggagtatcttactgtgattttttttttttttttttttttttttgagacaggatcttgcttataaacccaggctggagtgcagtggcgccgtcatagctcgctatagcctcaagctcctgggctcaagcaatctttctgccttagcctcctgagtagctgggactacaagcagacgccatcataccctgctaattttaaaattttattgtagatatgggggtctccctatgttccccaggctggtcttgaactcctgggctcatgtgatcctcttgcctgagcctcccaaagtgctgggattacaagtgtgagctgccatatctggcgttactgtgatttttattaaaaaatttgattgtggtaaagtatatgtaataaaatttacttattttaactatttttaagtatatacttcagtggcattaaatacaccttgttgtgcaaccatcaccatcttcttgtgatttaaatttgcatttcttgaatgacttgaacatttaaaattttttattcctctttcggtgagtgtgttcagatcttttgctgattttttttcaaaccattttctttcttttttttaactaacccagcacaaagctgattttttttttagttttcttactgttgagaccttgattagtaaactggacaaagaacttgaacagatagttcacaaagaaagagaacttggtaaactgtggaaatgttcaggttggcagtaataaaaccactttttaattagctgctgtactacctggttattttttatctttatatttcagtaatgtatgttttactcgatggagcagtctactgtgcaagtgggagaatatgataaagttggaggagcagataaatagaatattgacattatgaaaaaaataaaacattcacgataacctggttgcttgatgaaggtagttgtggggaagaagcatgataaggtcaaaaggagagtactcttggaattgggagctagtttttaatcctcatttggcccttggttgataattacttggttctcagtaactgaaatagaattagctattcttagatttccagccagttttctgaaagtgtgacagttcagtgataccctagatctcttgtatactgccttctccttagtcttgtgtggccttagatgtgttatattaccctacccctttcaacctcagtttcccaaactatgagattggtattgtgaggagtaagtgacagaatacattcggagtgcttagaactgtgtgtagagatggtaggtgtattagtctgttttcatgctgctgataaagacatacctgagactgggcaatttacaaaagaaagagatttataatggacttacagttccatgtggctggggaagcctcacaatcatggtggagggcaaggaggagcaagtcacagggatggcagcaggcaaaaagagagagcaagtgagcttgtgtgggggaactcctgtttttcaaaccatcagatctcatgagacttattcactatcacgagaacagcattgcaaagacttgcccccatgattcaattacctgggtccctcccacaacacgtgggaattcaagatgagatttgggtggggacacagccaaaccatatcagtaggtaatgaaataaagggtagttcttagctgatgtcaaagtaacaattgaatgttgtgcttttttatacttttttttctttgaggcagtggctggtcttttaaaatgccttcattaaagtttctagtacattataccaaatagaaattaaaagacatgcaagttgctgctggctggcatctataatcccagctattcaggagtctgagacaggatgattgcttaaggccaggagtttgagactagcccgggcaacatagtgagactctatctcctaaaaaagttagctgaatgtggtggtgtgctcctgtaatgcccactcctcatagatatttcaaaatagtaatatttattgctgccaatgtgagtaggccaaaaaaaaaaaagagagacatagagacatggaagatcaaatgccaattaattacttaaaattgattttgagaatatgaaaacatcattttggattttgatgttttctgctccataatggagcagaaaattaattttcattttccttatatttgtttttctcctaagacccaattgaggggggagaaaacccatagcatcttaaagatctttatttttttatcatgtctgtgtactattgttagtggatataatgctttatgaaatgtggtcatttcagtagttttataaaatatgttttgatttaaaagcatgtagcaatagtgatcattaatccattcattagaattttttatacttcattatacaattgactctgtgaaaatagatgctagggagattttaaagagttattaatactgcttggaaataataatatgttagaattccctttaggattattttttttccccacttgagacctaacctgtcattgttttcatataaaccaaaccacttaaagtaacaaatggattaatgcacttgttcttcctcttgacgaactccttgaagaacaattttggaagtatttattaatttgctttaaaataacaacactcattatgtgttaatataaatactgtttttcgtgaaaataactattccaaactcccaaaattgatgaggaaagtggatttgttttatatttgccaatctctttaatacctattttaatgagaagcagctgggtcttttcatctctagctgcattcattctattatctcatgtagcctctagaaaataccactgcaaactggcaagacaataagtgaaaaagaagtcttaggggctgggcatggtggctcatgcctgtaatcctagtgctttgggagctgagatgggaggattgcctgaggccaggagttagaggttacagtgagctatggtggtgtcactgcactccagcctgggtgacacagcaagaccctgtctcttaaaaaaaaaaacaaaacaacaacaacagcaacaaaaaacttaagtgttactaggatagtagttgtgtctttgcattctctgagtgagaaacttgggatcccagttctcttctctaggccaagcagagccctggggcttgatttcagagttgttgggtttgcttagtatcttgtttgttggtttgtcattcagaaggacaggggtcttctgaaaaatcagtgccctaattcatgtgtgtgtctacatccttctaagtggagatccatgtctctctccccactccacctgtcctgttccaccattcgctagctggccatccacttggagtcagcagtgcttcctgtggtgagtgtgccctggagtttgccactgctttggtcctgaccacagctttctcaggccacgcagggctaggttgtctaggtggcagtgttttgtatcatggaatgagcccaccaagtgaccaattgctgtacccacgtggatgtcactccacctgttgtccttgcctctcacaggcagcaatgtgccagcaggactgtctttgccataccccaggccatagtcaatggccgacccgtcacgatgttcctggagggcagcgtcccacgggtgggacaccctttgtcatgctgtggctgctataccctacttcctacttgcacagccatctgaatgtgggctagggagcccaaaccctatgcctgagatctgtacatccacacttgcacccaccctccctggtagatcctacagtagtagcacatgccagtttcaaaagttaatccacagtattgttgtgaatggctggatgagggttcagctcctatatagataactggttattgtaggactgatccgcacctgtggcttcagtgactctggtgattctaggtaacctagatcaatcacattttctccccacccccaccatggccctgtcactcttaggtggcagttgtagtgcctactgaggcgaccactgtgaccaagaatcttaataatagggaatctcaatttgattctgcagagagagagcctgataaattaataccctatctaaagaatgcagcaggcgcacaaattacccactcccaaccctggaggataatgattaaaacaatatagaactctttcaaggccctgtagttggaaagagtccagtttaaatcctttaaagaggatctattgcagggcaagcctggtgctggcagccacggtaatcccactttcaatgtggtgtgctgaattcctggcagttaaaatgcttgtttttggatcttaacgtgctgccggggtccattgcaagaaagtccatgcctcttgtctttttggtaccttacgggctcttcttccctgagtttccctggagctgaagtgtgcacttgaagaaaattagtgttcaaagtagcgtgggctgcctggatactgctggtgggaatcatggaatgggagcgtggttctattttgtttgtgttggaactttgaggaagcttattaagcagggcagttggggcattagtattgcaccgctaggactcaaattctgggccagtaataagactgatcagagtgaaagtttttgccaaggatgttttcattaaccaagaatgaaggtgaaagtgggaagtttaaagatgttcaggtcctgtgtagttacgaacataaatgtgatgttgaccactgcattaatgcccatgacccactagcagcttccaggaaaccagagccctttgggtcgtggtagggggaaggtctgtgttcatagctgaaactgaaaggcaacagcaatagagacagcttaatttgactgaacatgagcaaccttacctgcttccagcacagacaggattgtcccattgatagttattctgtgggtgggggtgcatggcttttctacttgatgaagagattttgagaggtgacagcatgctggcagtcctcacagccctcgcttgctctcggcgcctcctctgcctgggctcccactttggcggcacttgaggagcccttcagcccaccactgcactgtgggagcccctttctggcctggccaaggccagaactggctccctcagcttgcagggaggtgtggagggagaggcgcgagcgggaactggggctgcgtgcagcgcttgcgggccagctggagttccgggtgggcatgggcttggtgggcctgcactcggagcagccggccggccctgccggcccaggcagtgagagacttggcacccgggccagcggctgcagagggtgtactgggtcccccagcagtgccggcccaccggcgctgtgctcgatttcttgccgggccttagctgccttcccgctgggcagggctcgggacctgcagcccgccatgcctgagcctcccacccactccatgggctcctgtgcggcccgagcctccccgacgagcaccaccctctgctccacggcgcccagtcccatcgaccacccaagggctgaggagtgccagcgcatggcgcgggactggcaggcagctccacctgcagcccgggtgcgggatccactaggtgaagccagctgggctcctgagtctggtggggacgtggagagtctttatgtctagctcagggactgcaaacacaccaatcagcaccctgtgtgtttagctcaaggtttgtgagtgcaccagttgacactctgtatctagctgctctggtggagccttggagaacctttatgtctagctcagggattgtaaatacaccaatcggcactctgtatctagctcaaggtttgtaaacacaccaatcagcaccctgtgtttagctcaaggtttgtgagtgcaccaatctacactctatctagctgctctggtggggccttggagaacttttgtgtcaatactctgtatctaactaatctgatggggacgtggagaacctttgtatctagctcagggattgtaaatgtaccaatcagcaccctgtcaaaacaggccactcggctctaccaatcagcaggatgtgggtggggccagataagagaataaaagcaggctgccggagccagcagtggcaagctgctcgggtccccttccacactgtggaagctttgttctttcactttttgcaataaatcttgctactgctcactctttgggtccacactgcttttatgagctgtaacactcaccgtgaagatctgcagtttctctcctgaagccagcgagaccacgagcccaccagaaggaacgaacaactccagacgcgctgccttaagagctgtaacactcaccgcgagggtctgcagcttcactcctgagccagcgagaccacgaacccaccagaaggaagaaactccgaacacgtccgaacatcagaaggaacaaactccagacgcgacaccttaagagctgtaacactcaccgcgagggtccgcggcttcattcttgaagtcagtgagaccaagaacccactaattccggacacaatttgactggtagttaatcaataaccagggagattagcgtgctaaccagttaggtgagcattcggcatctcccaatttagacaaatggcattcagccatctgagattgagcagttaggctctggattgcccagctggttagcacacagatagatctctccaccagcctagaaaaggcatgcaccccactcacagaagagtagccacaggcctgtgatgctcttaaatgcctgtaaccacgcaccacactgctctcggcatgtgctcacttgaatccgatggatgtcagagacccgttaagtgcattagtgatggggatcgggattgtagtaagtcgtcgttaaggaagaatttcccgtgagagattaggctgaaagtgtgcattaagtttctgcccattctccctccgataggccactagggattggctcttggccctgacagatagctgagaacggtctaaaataaaagttataaccagggttccctaagtggacccgggtaggagctttagagcgagagtgcgaaggatccgtcgcggttcctctgccgtcgtgctgctttggggccactccaggcagaagacagacaaatatgcccctagagtcttgtagtgctgggcatgaggggtgggctgcggtccaaggaccccttagcgctgtcccttctgcttaaggtggcttccggctcatctctctgtggcctggtgcttttgtggctttggggtatcccctccccccaccagcccttaaagtgtgtgtatgtgtgtgtgtttctgggtctgcctaccttgcactcttgtggggtggggtgacatgaaaagcttgtcttctaactgctgttattgtggtgagtcctcacatgtgttttgtggagtttaggctgttaggactttaaaccgttaaattgttaagactggagtttaaaactgttaggacgctaatggtgacctgattttacatatttttattatttgttgtggagagcgcagttttgaataaaaccatctgtttctcttattttcgactttgatttatttaaaatctgtcatacgaaggaacaacttaacttttaatacattatttaggaattttttagttttagataaacacttgaatagcaacttaatcacaactttcagttctccgtactattaatgttttgtcaagtgatagattcttgctttaatgtccaatattttggtttatgcttgtttcttgcttttttaaaaaagttataaccaaaggaaattcaattttcctttttcattggcagacatatgtagagtgtgtcggtcagaaggaacacctgagaaaccgctttatcatccttgtgtatgtactggcagtattaagtttatccatcaagaatggtaagtcatacttttagaaagttatgtaagtctgagcttcagtttcgtcatgtatacagtaacagggatcatttcaatgtactttctctgtaattatttttaaaagttttattgtattttcctgagcacaggaaactgaaaaagcccttttattgtaaaaattaaaaaatttggaaaagaaattatccattaattcttaataccatggctgttattttggtgtatcctcttccaggtacacgtaattacccattgtttatttctaccatggagagcttattttgtcctctgaaagtgttatgattttctagttttgcttggcataatagtagcttacatttatgaagtactttttgccaagaactgttcttagtggtttgtacatctcaactcatttttaatccttataagaaaattgtgatgaggtggagtattattattatgcagatgaggaaattgaagcatgggaaggctagataacttgtccttggccacatagccagccagttagtggcagaaccaggattcagacctagctaccaggtaccagtattatcagaccaggattaaaactgatgttgatgcttagagattctttcatgttcattttgctttgaggaaattacagttttgattaattgaaccttttttaatggtagaaaaatgtgttgtttttatctctagctgttgtagtttttcattcttagaaggcagttacaaaaagttaagaatattctaaatttgaaaattttgaaactaaaagctctgtgatatatacatttttaataaaaacaatgttttcgacaaaactgtaatgtttctttgctgtaaacactgtacttatgaatctatttataattacagcttagttcaatggctgaaacacagtcgaaaagaatactgtgaattatgcaagcacagatttgcttttacaccaagtaagttctttagacattttcactgcattttttttggttatcactcgtggcataaaggtgtttgatatgatcagttgacagaggaagggggataaaagtgcttaagcactttaaagcaattattttcagcttgattttttttgatagtaataggaagtattgatatttaggaaaatattttgaaaaactgtatgctgtcttttatcacacacatgtttgagatttgtggggtgtttttttttgtctttaaaatttatttacttttaattgtagacaggttcgaacacatgcaaaaatctaacaagtccacatgaacccatcacttagtgtcaactcatagcctgtcttgttttacatacactcttgttccctgcctctttatccttttatttttttctctattatttaaaaaataattctaccatttgtaatttcatctgtacatacttcagtatgtatctctaaaaggtaagggttctttttcaaaaacgtaactataataccattatccacctagaaaaataaacaatgatgccttgatttcatcaaatattcagtactcttcaaatttggactacattttgagttaaagttgtataggttagaataatagtcataaagataaagctttttttttttttgagacagaatctcgctctgttctgttgcccaggctggagggcaatggcgtgatttcagctcactgcaagctccgcctcccgggttcacgccattctcctgcctcagcctcccgagtagctgggactacaggtgcccaccaccacacctggctaatttttttgtatttttagtagagacggggtttcaccatgttagccaggatggtctcgatctcctgacctcatgatctgcctgcctcagcctcccaaagtgctaggattacaggcgtgagccaccgcgcccagcaagctttttttaaaaaaataataaaaaatagagagagggtctcactatattgcccaggttgttcttgaactcctggcctcaagcaattctcctgtcacagcttcccaaagtgttgggattacaggcttgagccacattgcttggccaaacaaagttttaaattaccgtttttttcatgaggctaacttttaaggtcaatatttcataagcctttataaaatatttttgcagcctttaaggttttaactatgattcctgtgcctattaatatttaatatgttttatctcaaataagtagaggactgtgctggcaagttattaaatatttgaagcataatttttcattctgggatcccctatattgccttcccttacaaaggatttttgtgttttagttgtgtgtgtgtgtgtgtgtgtgtgtgtgtgtgtgtgtttaagcatcttgagcttctcgatataaatgctgtaacttagtgttttactttgtttttatttgatgagtataaatgattaaagttattacattttcacttttggagctgtatattcatcataaaaaagtcaattctgttattttgtagtcattaattttctgtagtacgtaaaagctgtacagcttgtcaagattcataggaaactaagactaactagttgagtatcttcatgaaattcagttgataggaaatatgtgggcttttactttgaggccaatagaagcttgttttgtacattttaattttcatttgatagttacattctctatttcttttatcttttgcaaaaaatctctattattcctggttttaatgacttgctcttgtataccagatatcctatcgaagtcaatgatctgtgggcatgtgccattaaaagttgctatttgtggccaggtgctgtggctcacccctgtaattccagcactttgaaaggctgaggcaggcggaccacctgaggtcaggagtttgaggctagcctggccaacatggtggaaaccctgtctctactgaaaatacaaaaatcagccaggtgtggtggcagacgcctgtaatcccagctacttgggagcctgaggcaggagaatcacttgaacctgggaggcggagtttgcagtgagctgagattatgccaccgcactccagcctgggcaacagagtgagactctgactcaaaaaaaaaaaaaaaaggtgctatttgtcagttgtttatttctcaatgtttataggtgtgaacagttttgtgatagtgttcttataaattttagatcattgcttttaaaccctgatatatcataatttcttgttttggccttactggagaaagaattgtttgtttttcctttatgttctttccgagctacctgtggtagaggtttttgataataggcagtggttttttattggaaccattttaaaagggaatcctttttaaatgtggcagaacttttctttttctgaatgtgttgagccacatttctcagagtagtgggaagatctgaatttatcatttgaaattttaagtattatgctaacatcgggaaagtggctaacaaatgtcagtgggatgtttgctcccacatgaaatgatctgctgcggactgttgtgctttttgagtgctatttaatgcttatatttgggggagtgttgatggcttgttgtcagcttcatcttttgctcctgtttgctttattacatcttttatagtttgggaaaccagatgattatattggttgaatgttaaaatgtgtgtaaatgggccttgtatgaggttcatggctattagcaagggatgtgaacatctattgaatttttttttcctgcccagaggcctttgttgatttccacgtttcacatgtgatttgcctcataaatgacttcttgggtaaatgtgatattataactatttggtttattttttttaaataggaaaaaaattaagcacaaggcaaatattggaagtttagttaatgtctattttatatttatgaattaagctattttcgaatcttcatgaaactgtaagtactttttttccgcttatagtttattctccagatatgccttcacggcttccaattcaagacatatttgctggactggttacaagtattggcactgcaatacgatattggtttcattatacacttgtggcctttgcatggttgggagttgttcctcttacagcatgtgagtattcatgcctctgattggagttatttaaacattgcataactacttaatattataaagcaatattgcatcatattattatttgactgatgtttagttatttgatgtcagagtgtcatgtattaggaaagccttacttagaagatgttcatcggaactaagaatgagtttaacaggtcagttttttgagtgaatgtgggaaagaacacagcatacagaatggctaaccatgaaagttcatgaaagcgttgaaaaaatcaaatcaaatcataattagatatgaagtatgctagagctttcaagggctacaaaagacggccgggcgcggtggcttatgcctgtaatcccagcacttcaggaggccgaggcaggcggatcacgaggtcaggagtttgagactagcctggccaacatggagactgaggcaggagaattgcttaaacccaggaggcggaggttgcagtgaactgagatcgcaccactgcactccagcttgggcaacagagcaagactttgtctcgcaaaaaaaaaaaaaaaaggactgcaaaagatgaattcttttgggattctgcaaccctcctttaaaaaaatactcacatggccaggcgtggtgactcacgcctgtaatcccagcactttgggaggccgaggtgggagcatcacttgaggtcaggagtttgagtccagctgaccaacaaggtgaaaccctagctctactgaaaatacaaaaattagccgggtgtggtggtgtgtgcctgtaatctcagctactcaggaggctgagacaggagaatcacttgaacctgggaggcagaggtttcagtgagctgagatcatgccactgcattccagcctgggcaacggagtgagactttgcctcaataaaatacaaataaaatttaaaaatactcatacatgtaatggtcataaataattgggaggcttatctttcagatataggaggctctttgggagggtggtatactaatcaacccccctaatcaatccaaagaatcctcttggattctttgttgttcttatagacatggagagaagtacatagtatatgggaggcagagtatatagataagattcattagagttaaactaaatgtttaattagtataattgatatcttcatgtctccttaaaatatgataaaataatcttgattacctatggaaatgaaattcttggaagataccaactagcagaatataggtactgttgaagagtgagttagctagaaaatgtatcaaggaattctcccaggatgaaactcagagggacaaatagttacaagtatgagaaataaatattgacaaatggaggctagtctagtctgtctagtaagtagttccacaaggtaaaagagataatggagatgaggaaacaattggtgtcttttagattgaacgagaaagctgaccatggtaaaggaaaagtctcatgaacctagacatattctcaagttttctggagctgggtagggtggcgatggtgatagaggtatagagattgtatgcttccagattatcctacaaagtaaagaaaatcagagtggcatcagacttaaaattagcaatgttgaatgctagaagacaatggaaactcaaaatttgatgtttttgaacctaaaattccctttctgcaaattactctcagattgaaggacaaactacagatgtttcaatggatgtgagggattggaaagtttactaccttaaacctttttgaaaaaacaggatatactttactaaatgagcaaggaatcagagagaaagatgtgagatacaaagaagtgtttcatatagctaagtctcaattgttaatctgcaataattaatagtttttgggtaacagcctggaactaaaattccagatgatcttaacgtgggagaaattgtgacgggaagatagaaattaaagcttttaaaattgcttatctcatttgtggggagattatagatgttctagatgtaggtagaaaaatacagcataactgtgcattaaaaatgtggactagacttataactacccagaactggactcaaaactacattgttacattattaatgacaaaagtgccaccacagatcggtggcaaaaagatggtcttttcagtaaatggtatggcagcaatcagatggccgtacagaaaaaaagaatcatatcattacctcaacctaacacagaaattaatttgagatgaatttaaaagcctgaatgtgaaagttaaaaagaaacttctaaaataaaatacaggagaataagcataaaacaaaatattagtaaattgaacataattaaagttaaaaacttctcttcatccttagacacttttaagaataaaaggcaattgaattctggcactcaaaaaaaaaaagaaaattgaaagccatggagtgagagaagatatttgcagtacccatagccaacaaaggacttgtatctagagtatataaatcaataacaaaaaggcaaacacatcccaattaagcagtggacagaattttgaacaggtatttctggaaaaatagctaaatatactaagctctccgtatctgtgggttctgcaatgctgactgtagaatgtgagcatctgtttattttgttattgaggagagtcctggaacccattccccatggataccaagggatgacagtagccaataaacacatgaaaaactgctcagcatcattagagaaatgcacaaggagggtgactaaaaataaaaagagtagacagtgccaaatgttgctcaggacatagagcatctggaacacgtatacagtgatcaagggggagcgcatatgttataaccactttagaaaactggcagtatctactgatgctaaatattacaaataccttatgatctagcagttccattcttgggaatataactaacagaacaagaactttctgttcactaaaggacatatgtataagaatgaccacagcagttttattaatagtacttaaaaactgatatcagtcaaatgcctattaatagtagaatggatacatcgtggtttattcatgcaacggaatactacatagcagtgaaaaaagagctaactattgtgacatggaataacatggattaattttgcttctttgacaaaaacaagccaggcacaaaatcgtatgattgcatgtgtgtgaaattttaaaacaggttacattcatctatagtggtagagatctgaatagtggttaccttttgcaggggctgttgcctgggaagaagcttgagggagccttctggggagctggaagtgttgaacatcttgatttgggtggtagttaccaaagatatacatattttaagaattcacccatctgtacacttaagatttatgtaaaatatactttaataaagacataacaaaactcaagggcaagtgctagaagaatagaaataggatgagtgggaaacagcaaataaaatttggaaatttcaaacaaaggcaggaaagaaaggaagggaatgcagaggaaggaagtagggaaataaaattaaatacatctgtaatcataagggtttagatttctctgttacgagagagcttcatagatgtgtaggtataaaacttgcactactacaagagataaatacaaagcagcacaggttaatgctaaagagatacaaaaatagttttgttagcaaatggctaacaaaaagccagagcaatattaatcagccagttatcattcaaatgcattaaatgggacaaagcattatatttcatattaataaaaggcataatccactaagaaaatagaattaaagaacttttatacaccagaaagctgggccttgaaatatgtaaagcattcacagtcatagtgaaagacttaacatgcctctttgaaatcagtagatgaaataggcaaaagtaaggacttacaagatttaacagttattaatcacaagcttgatttctgttctaatttgtttatatacagatacacacaatttaaattacatcacacgatacatattctgtaacttttctctagcttagcatcgtatcctggtggtctttccatgtacgtgagtgttgtgctgtcttatttttttttttttagcgatacacagcactctgtagtaagaaggcctgttgcacatgaatccatttacctatctaaacatttggtttgtcagttttacattgttacaagcatacttgtctgagtattttataaacatgtaagtaatttttattacagaaaatcttttcctacctttccattttgacttggttttgaaaacagccattgaagtcactgaaaatctgattggaagtctccgatacaaggctatatagggaatgcttaagctaatacacaaatactggtttgaaagaaagcctcaggtttttattcttgtgccccattttcaaatctgtggtctgttatctcattctgtctagaattctgctttcctgactaaaagactttctgccttgatagcagttcgttcacccatactttgtctttctctaaatggccagaatttagaataattatattctgtattttagaggacctgtgaatctgtgcttttaaaatattggttgtcaggttgccatttatggcattgcagtacatactctactgaaaaattctcttaatttcaaagacttatacctccaaaactgaaaccttttattgtcatgagcagacttaatgaattttggaattctagaatttaaaaaattctttatattataattttggagatctttactttagatttttcttttcaaacatctaagctcattcaataaaaaaaagcaactaaacctagagagaatctaagtgctaaacatgattgtgtaacatttactcttcattgtcactatatttgtgcttgactgtgtttttaaaaatttaatattttgagacttaggcttgtaaagactaaatgtttatttcagtggcatttgtggcgttccactttacctctgctttcttgagcagctatgtgaattcatgatgcgagttgtgactgtgtgccatcatgctctttttcggtaggccgcatctacaagtgcttgtttactggctccgtgagctcactactgacgctgccattagatatgctgtcaacgtgagtattgaacctctgtgacgaatgttgcatgatgtagatgatgcttgcttttttccttgcatatttattttattataatttgtaaattcttttgttttgagaacaataatttatgtctattacactaacagttatagctgcagtagaagtagctgataaatgtaaatgacacttcttttaaaacatacctgttttatgggactgttttgtaatgatgggatgacttttctttctttcttttttttttttttgagatggagtcttgttctgttgtccaggctggagtataatggtgcgatctcggctcactgcaacctccgcctcctgagttcaagcgattctcttgcctcagcctccagagtagctgggattacaggcactcgccagcatgcctggctaatttttgtatttttagtagagacagggtttcaccatgttggtcactctggtctcgaactcctgacctcaggtgatccacccgcttcgggctcccaaagtgctgggattacaggcgtgagccaccgcgcccgtccgggatgactttttaaataggctgtcacgcagtttgagatacatactactgtcttatgttcacaaaagtttttttgttttgtttttttaaatggagcctcgctctattacctggggtagggtgcagtggtgtgatctctgctcactgcaacttctgccttctgggtctcctacttcagcctcctgaatagctgggattacaagcatgtggcagcaagccaggctaatattttgtatttttagtagagatggggtttcaccatgttagccaggctcgtctcaaactcctaacctcaagtaatctgcctgcctcggcctctcaaagtgctggggttacaggcatgagtcactgtgcttgcccaagagttcgttttaacatgtgtttttaacatacacatttgaactcaaatttattttttaaatgttttccatgattattagaatataaatgctaagaacttgcctgtagttactttactatatcttgatattaagcattgttgcttgccttatattggcaggcttctttttccctctcacctgataggcttgagggtcacctgaattgctttcattagactactcattgactccagaggaccactggaagcctagtggggctagtcaaaataaattataaacatggcttggttttagctgtcttttacagtttgaaaaattgagccagtttttctgatagcagttgtgaccaaactactttttttctgagtaatgttttacactctctatagaattttttttctgtgaaattttactttaaatttccttaatgtcttaccagtttctatgtattctgtagctcagtaattgaggtcatgtctaggtgcactgtatcagttatctattgctgcaaaacaaactgtcccaaaccttagtggcttaaaacagctaccattttatttgcttataattctggggtcagcagtttgggctgggctcagctgagcttttcatctattgggcttgcctaggtcactcagctgttttactgggacttaatgatctaagatggtttgtctgagatgccttggttcttctctttgtggcctcttatcttctaaaaggctagtagggcttctttacatggtagtctcagggcagcattctaaaagggcaagagaagaagcttgcaggccctcctctgggctctggaacttgggcagcatcgcctctgtccaggattcacaaaaccagcccagattaaaggagtaaggaaaaaggactccagagtttgtcaccaaatgtttaaaatctgtaacaaacagttaggattattgctgatagcaaggaagatgtaaaggggatattttggtcccaacctttcagaatttagtagcctggagagttccttactaaggtggtagttaggattcctcttttgattcaggacatattgcagactatattttcctagaggccataccagtttagtttaagtttggagctgctgggtcaaggtctaccagattgacccttctcaggttttctatggaggaaaaaagtgattccattaaaataatggattttccaatggctaagagtccagaggcttttgagttatctgtgaataattctgaaatcataaacatggactagggaaggaaagataagcctcttaagaaaggaaaaggacaaaatggtcttcagtatcatgatatttgatgcattttcttgtatgattactaaaggaaccatactttgcctttctgaatttgttgagaaactaatacacttttggtatgattgcagttagcatcaaaacttggtttgctttctaaatgaaaaatttctttttttttgagatggagtctcactctgtacccatgctggagtgcggtggctcaatcttggcttactgcaaccccccgcctcctgggttcaagcgattatcctgcctcagcctcccgagtagctggaattataggtgcacaccatcatgcctggctaatttttgtatttttagtacagatggggtttcaccatgttggccaggctggtctcaactcctgacctcaagtgatccacctgccttggcctcccaaagtgctgggattacaggcatgagctactgcacctggccaagtgacaaacttctataaaatttataatagacctctttgtcttacatatggcatactgaatatctctcaaccttcatttctttatgttgtcattagacttatctggaggagcttctcctcttttctgatttgatgattctattaatttgtgtgggttcaggtgtcagctaatcaagtttttaaacatgtgtaaaataaagatacagaaactcttagagttggacagagtttttaacctttggtaaattacataaatttaatgcatggcctttgtcaagtgttagactgcttttgtctttttttgcgtgctgcctttctgtttctaggccattttcaaaagataggctatggataggtaatttccatatagttctgatggtatttgatgcctaaataaaatacataatacaagtatgtaaatatgtataggttctcttgcaagtagaatttcaccataatcacaaatagttcttttggagaaacttgagattttcatccaaaaaattatgatttattcttctggctgttttttttttttctgagactttagtataagaaaattttttacctttgttttcctaattttaagtcttctttggagtaattatatgtacttttttttttaatagggaaaatttgttggcagattgtttgcagggttgttttgtggtgacgtgcacactgtgtgcattcatcagcctggtgtggttgagagagcagatagtccatgggggagcaccaatttggttggagcatgctgccccaccgttcaatgctgcggggcatcaccaaaatgaggtaactcccctaccccaaaattgattttacttaggtaggtcatgagaattattgtttctctctgagactcaaactcttgacttccatgtccctcataaacattcttttgttattacaaaggagggcagcggaaaggtttgggtgaagatgaagagagatgtgaaaaatcaagaaagtggtattacgactttgcctcttaattttctagttagagtgggaacagcgttggggggtatactgaagtccatgtacacagtcttacccactgagcagaaatttgaaaacatttcctcaagtgtttgatgacagagcatgtatgtatatatgtatgtacatttttttaaaaatgtattttcatccctgatgctgtcaataaagacaaaggctgtcttataaaaaggactacagaatgtttttaagagagccagatttgttaaccattttctataatgctttgtgaactgttaatccgctaaattatactgaatgaatatgtacacgtgttatgaagtgaggttgtgttcttatatactaaaattgatcccacatcagatacatttaaaaaagatgtctttgaaaggttttgtttttaaaaagaatttagtagagtttatatttgttttctagttttttgtttgttttggttttttgagattggctcttgctctgtcactcaggctggagggcagtggcatgatcacacctaactgcagcctcacaacctctgggctcaagagatcctccttcctcagcctcctgagtagctgggactataggcgcaaaccaccatgcctggctaactttttaatttaagtacagatagggtcttgctgtgctggccaggctggtcttgaactcttgagctcaagcaatctgcctgcctcagcctcccaaagtgctaggattacaggcatgagccactacacctggcctaggttttttttttttttttttttttttttttagcaggaataatgtgatttggaaacagagcaaaacagacaagtggatctaaatttctgggcttttctgtgattttaggctccagcaggaggaaatggtgcagaaaatgttgctgctgatcagcctgctaacccaccagctgagaacgcagtggtgggggaaaaccctgatgcccaggatgaccaggcagaagaggaggaggaggacaatgaggaggaagatgacgctggtgtggaggatgcggcagatgctaataacggagcccagggtaatggctgcttgtgtgtcctcactcttcagcactgcaaatctgttctcaacttgcattgaggaaaagggctggcgttttcaaatttttaatgttgtgaagttctatttctaacttatttttactttattttggcaaactggcatttatggatgtacatatgcataaatatgtttttttctatgaaacagggcatgttttgtgttttaaaatcctttttacacaggccttttttttttttttgggagactgagtctcgctctgtcgcccaggctggagtgcagtggcgctatctcggctcactgcaagctccgcctcctgggttcacgccattctccggcctcagcctcccgagtagctgggacaacaggcgctcgccaccacgcccggctaatattttgtatttttagtagagacggggtttcaccgtgttaccagtatggtctcgatctcctgaccttgtgagccgcccatctcggcctccaaagtgctgggattacaggcgtgagccactgcgcccggcctacacaggacttttttaataggatagataggaagaaactattttttaagttggattaggtactactttttttaaataaaggactttgatacagattcacctcattcatttgcttctctctttccatgtcccttgagtcagtgcaatttctaagattgaaaaagaatcttgaagtttatactgcagacaagatgccatctaaataaatcaacgtctcgttttctagcagtgtaaactctagaatgtaaaataagatccaagacaggagatgggtagatcacctgaggtcaggagtttgagaccagcttggccaacatggtgaaaccccatctctcctaaaaatacaaaaattagctgggtgtggtggcgcacgcctgtaatcccatctacttgggaggctgagataggagaatcacttgaacccaggaggcagaggttgcagggagctgagatcatgccactgcactccagcctgggtgacacagcaagattccgtctcaagaaaaaaaaaaaaagatccaagacagggtctaccagtcagctgttggtcactcacttcccctcctccctcccaccacagttttcctgtcaagctttgcactatctctagttctacttggcagcctgatatttttgtgtctctttgtgtcacgtactctgttagacactgagcatataactgtgaccaaaacattaggctgctgcattcctggagtttctggtttagtgaaaaagtaggaaatacacgtcatgatgagtgttgtgcgggttgctctgaggatgctgttggggagagacctattaatttacctttttttttgagacaaggttttgcctttgagccaaggtcacctgggagggagtacagtggcaggaacacagctcactgcagccttgaccttttgggctcaagtgatcctcccacctcagctccccaagtagctgggaccacagatgtgtgccatcatgcccagctaatttagtttttgtttttgttttcttggtagagatgggttctccctgttgtcctggctggtcttgaactcctgggctcaagtgatcctcctgcctcagcctcccaaagtgctgagattataggcatgagccattgtgcccagcctagacctattttgaataaggttttccaggtagctcagagtacctggtatttgagctgagacctctgaaggatgagaaaaagcgacttgtgtaatggtaacagggggcctttgcagggggaggtcagaggctctgagaatacagcctgctgctacccttgagtctggccgttatttctctctcttgatctaatacagtagctcctaactattctttctccttccgttcttgctccacatagttcatattactctgctgcctttaaatcttttagtagttttcccattactaaagaataaaatccagactccacattcctcttgtatgatctgatttctgtctttctactacccatatcattagtcagaatgtccttagttccctggcttccttacttttctcaaatctgccagattctttcctggcttagagctattgaattcctctctttcagataaccttatttattccttttctagcatttatctcaatctaggattaccttactttatatgtattatttatttatatgtatgtttttattcttatttgttccctgacaagcaaatactcagtatggaaatgtggcttagcttctcaacaacagcttacaaagtactaaattttactatttttagtgcattctattttttttattatttattatttttacttcaagtaatctttaaattgcaattatattttcagatgacatgaattggaatgctttagaatgggaccgagctgctgaagagcttacatgggaaagagtaagacctttttctgtcaagtatcctggtgttttaatcctaaaatatattttaaactttggtgtatttagatgtatacactaatgttatcgttacagttgatgaaaagttactagaattttcattcctagtgaaagttaagtgatatattgtttatggtcaaaatattgtgatgttggtggctttttttggtcttacaaaatcttgctccatttaggaaatgttttacctgaaattgtggacttttgaaaaacaaaataacaatttaaatttaagtagtattttcatgcttcagttgacaaaataatacagttttattatgaagtaatcttaattagctgtatatcttgagtaacaaatccaagacggaattgttttagactttataaatcatgtaattttgaataaaaggagacccaaaatataaaactctcattcagaaacagaattttttttattttctgaaaatgataggaagtattggaaagtataggaagtgggtgaggactgtgtttaaagatattgaaaggaaaatgaggcttttcataaattagaatagaaagttctgttgcatcttaaattaatgcttatcgtttttgtttattttagatgctaggacttgatggatcactagtttttctggtaagtaaaactaattttttttttttttttttgagacggaatctcactctgtcacccaggctggactgcagtggcgtgatcttggctcactgcaacctccgtctcctgggttcatgccattctcctgcctcagctttccaggtagctgggactacaggtgcccgccaccatgcccggctaattttttgtatttttagtagagatggggtttcaccatgttagccaggatggtctcgatctcctgacctcgtgatctgcccgcctcggcctccccaagtgctgggattacaggcgtgagccaccgcgcccggccaaaactaattctttctagtaacagaattggagttgtcttagtgattcagaaacttcacatttatagtatgtagtaaaggtcaagatgccctttggcttttaattactttatatgttgaagattgtatgtttagtgtgctgaaaatattgaaaaagcataaaggtaatatttttaaaaaattgttaaatatttgatttttagcaaagaaaataaaccccaaagttaatggtagttaaaaagaacttggtcttcttttaaagtttcatcttgcagtgtttattgcctgtactggtggaagcaaagcagttttccctattttcacagtgagacaccccaggctgatgttaggttttcctgtttgctgaaccccacctgtctttacctaggaactttgccatattagtaaagattgcaagtctaaggtgaggagcaattctttaaagaacttgttctttaaagaagaaatggtgctgttttcaggtcctgtaatatgaagttatttgccatttgggatttttaaatagcttaagatgactttggctgcaggtagcagaacccctgctggttggaacattaatttaacaggaagtccagaggaagaatgggcttgaggttgcttgatccataggcccaacaatgtcatcagagaccgagatatctccatctgtctcctttgctgtcctcagtgttggccttctcctcaggctggctccagatgttaaccagaagaggatgttgaatttagcagttgtgtaggtttttaggaacatatctggtataattccacagtttagtgggaatgtgatattaatgagcttctagtcatggtttgatcacagtcagtatagaaagcattatttggccacatactgatttatattccttaccccatcagttcctcataaatgaaggacagaagtcgttgaggtagtggtggtgactcaaactcatttgaattattggaaaaaccttcgacaggatgaattcattattttagtaaaaaatatttaatatgtatagtgtgccagctattgtgctaggcactggggaattcagtgcctatgaattcaatgcctatgaatgagacagggtccctgttctcaaagatgctctatagtgtggtagagagaaatgaacatgtaaacaaggaatgttttggagtctcagtgacaaaaagtgtgcataggacacaagaggggcacaaaagagggtttgattaggtctttcttagtggaatggagtttgtcagcaggagattttccgcgaagataacagaggttgaagtataaaatgtgttggggatagggaaaatttaggagcccttaaggcagagaggttgaaaaaattgagcccacatggtgagaagaaatgtagtagtcattcacaaactaattacccttctttctggttggatttgtggaagattaggggacctgaacagagaaatcctttttttagacaaaagatctttggacggatcatttaacttgatggttgcggggaaggttgtgggcatgaatgaatggacttgggcagtctggtcagtgtcagcatggggcatagctaaggtgtgtgtaacatggctgaaggaataggcagatagctgtcgccttagaggtgacagtatgtaactgtgggaggtgaccagatggtcaggtgagacaggacaaagaaagtcagggcaccatagggagtggagggaccagaggagatcaagctagagttttccaaaggagtggtagccaggcaatagtgaccttgtaggtgtcaagaaggcagattggacgttgaaagaaacactgcagttgacgttaacatgatgtttacaattaatttggctttcaaatttttctccatttgaaatttttagtgtcatttgatttaaatgaaatctggtggttatgaaaatctatgtaatttgtcgtagattatttctaaaaaggaagtgtttataaatgaatttgttttttgtacatgtaacatttttgagttttattaggcttagttgtatgagctatctaatgaaaaatgaaagttacatattatgtctagattgaaatcccaaaacaatagagggaaaatttcaatcttagctgtttttactatttggctctagctaaataagtggaatagtccaattaaacatacattaagtatgaattgaatatgctttattgatgcttttttcctttaggaacatgtcttctgggtggtatctttaaatacactgttcattcttgtttttggtaagttgtgtttgtgctttttttttttatagtattatggtaggaatttagttttgtaggagccttgttataggtttattattattttttaacatagaaataaatactaagcagtatatgaaaatagtttcagatacaaaccctgtatagataggccccagacagacagatactttcctaagcagcagtgactgcagttacctacctatctctccctctgttgggcatttctgggttttttttttgtagaagctggttttagaccgacttgaaaatatacagtttcccatttctggaattagttttatgctgattgtgtgtgctcttccctatggtggaatatcttgttttcatctgtcaaaatcctgaccattgccttctagagatcttgacttgggagctgttaccagagctgagtgtaggcttgtgggaagacagtaagccttccccaaatgtgagcaccccttagaaccagattccagcacatacaaaatcacttccaagcacttctgcgagggcagctgtgaggattctttgacagcacacaatggtcccttccattgggactaattagagaaagaaaggcaaggttgaggagacactgttgacagaggtttttctcctttccagaagaggtaaggaaaactaagttgagtaaaccaaggccttagaattcagtttctgtatctcttaggggtgaggacgtagagtctgatggaatggggttattgttaggtgtcctatgatttgtgtctcagagacttcaggcaacatatccctatatagggataatctatgagaaattccttccttagtacatgggatttacccctcagctctgctgaagaggatgagtagagatttcccaaggcttcttccaccaaattccaagttatttgctctgttgaggactacattgtgacgtgtaaagcagacgtctttaataagaagccatgtggtgtaaggggctttgaatatttggactgaggatgagaccaaaaattgatttctgtgtattatctgtaaaagaggaagataaatttacttgtattttgttaacaaagtatttcggatacttccattgatttcttaatttttagtagatactcacaaaggtgcagatttattaggattttttgttccctttacatgtgggggtgtctgtatgttatcctgcatttatttttcattatgtaaaataattcatatatagactgtgaaactgttatgatcttgactgcattttttttttttgagagaaaaaatgatctatagatttaagtctttactcttgcagaaaagcttaatgctaaattaatgtttggagaaccaggtcacatttaaaacatgaattatacaaataagaactctgatttatagaaatcaaatctaagtaaagctttttctaatccaacctcctgagcttatattgcgaaaagaattttcttagtaaacttatgttttattatatagttagaatcttttggaatcttttgaaatgaaacaagttttcttccattaggaacatactttttcttttaatcattgggattaaacaccctcctgtttttttcttgcatgggttgctctgttggaagttttctacaggcagttttttggctcttgtggtcatatgctttgcagaaatataatttgacaaagctgtggtcttccactagaaggtgacaatcctgagaaattgtccttaatttcaggatgcctttccattagtttgtgtgtaatgggatggaaattgattgttgcaactggtatttaaggttaataattatttaatacatctgctaatagagttaaaacttgcccctcccaggggcctagttgagtcatcttcagactgggatatgagagcaaaataggcaaaattcaacatacagtttttttccttaccttattaaatttcttctgctttatattacacacaatatgttagtaaactaatacgtatatataatttataaataaatttaaatatattggaaatacatgttcaaaaatattcttacccatgaaatagtcagaaagggttagaggccagatccctagtaggttcactctgacttctgtcttcatgattgagtttcccactcccctggtaatctactgcgctgtcgatttatttctaccataaagaaaagataactatattttattattaggaatgaagtaaaatttagccagaaagacttgaggaaaaagaagactataaaaattctcttgctataaaggttttaaaaatactttcatacttagctataatgccattatctcaccttacaaaattactagaatttggtatttcctaataatccatcatattcaaactctctgggttgtcccttacataccattttgcagttggtttctttgaatgaagacccaaataaggtccacatattacttttagttgttaagttataagttattagtcttttaatctagagtactcttctctttgcttcccccaactcaccctatttggccattgatttgttgctgggattaggttaactgttcttgcagcatgtcatgttttacatctgtccatctgcttcctggatgtcctctgcctttatcctttgtctcccatatttctcttaaactggaagtcagatctaagggccttattagattcaggttgaatacatctgggacaaatccatcactggtcacactgtgcctattaatagtatatgtgaggagctgagatacatgatgttggattatccacttttatcactggattcagctgatatcaacctgggcctctaatcttaggttttgtttttccctttaccattataaaataatctgttgggagtgatattttaaacagtcattttttatatttattggctgacttttctgaaagaagaagaaattcttatcaatttgggactattcagtcaacccaaacctgtctgtccggggcaagtaggacagatgctcatatttttcccattaattttggttttcagaataaggaattggtgtattaactattcacatgggtgtgctaactgcttccaaaacatcaaagtgttttctttgatgttgctttttctcttttcgtgattattattttggacttttccttttttgagcatcataaactcatggatttgtgtatgttcagtgtttttccatcagttttggtcattattctttttgatgctcatattatcctctctttggcctgttttcacaatggtttctgtgttgatttggcatggccctattagaccttaatagctttgttgttctctagttacagagaatgtcctaggcagtgtatttttagcctagttctggaatctttcatttctccaagaagccctagttccttttagtggggaattgtagtaggagtgttcattgttttgatgtcggagttttcatggaattttttccccctttttagcattttgcccttaccatattggtcatttctcccttgttggtttgggatttgaagaacacgtgagtataatacttttacaaagttactttcattcattactcccaaatgtgattattaataaaatagtattctaaagagttacatcatttcttcattggcattatgcaagggaatagttaggcaataccgtctcattcttttttaaaaaaaataacagtggctcaagagatagtggtcatgttgccaactaatgaaaatgtgctctgaaatccagtcagctgggtgggcctgaggcataccgtgggaaagtttcccacaggctgattttctgtccatctcaagaacctgtatgttctcttctttccctttccccaggtgccccctgctgaatttagaaaagtaacaatatatcaatcaatttaaaaagggtagaatattttggaatgacgggttgtagtgttttctagagtgctttagttttgacattttatcagtattttccagaggtaaataaattttggaaggattattacttctctgttggggccctagaacaatttagtcttttatggaaaagctgactatctgggatcatatgctcagtttgtatatttgagatctgagagatcacgttctgaagtcttctcatatttagtacacctctgattctcactagttgaatgcaagaacttgaaaggttcaggtaagtgttttgaaaaattttgactttccaaacttttgccacttgctatctgaaactcaggaatcaaaaaataccgacaggcactgttactttcaaaattctttctataagttgagaatgggacagatttgcagagcaagggaaacttgaacagttacttctagtggtaggaaatgaggtggctaggatattacccagctggtgggtgacttgggcagtgtgttcctgctttcagtggttagcctttagcaaatctgctttagagtgagagtagagggcaggctgttgtattacagtgctcttgtttttgtaaaatttaattcactctactgttattttgtctccttgggtaaagtgttatttaatttttcttcattttttagtaatatataacagtcagtgagagaatttggttttcagagatgtcatccaaagcagattttacagttgtttcctggttataaattgtctcaacaattctcttttagtcatttagattgtttaatatgggaaaaccggggtgtagaacatgttgtaaaattaaattttatttacttttttcttatttccaggtccaagcatctcattttgaaggcctaatcacaaccatagttgggtatatacttttagcaataacactgataatttgtcatgtatcctttaatgaaccaacttgggtgtacactaatattattcataccaaagaactcttcattaatggcgaaacttgtctatccttgtcctcttagtaaaagttgtaggtatttgcagtaagggtcagtgtggacaaaatgtgaaataaattaattctgtcaaaaaatactaaatgttggctaagtagttacctgtttcattgtacctttaaatactcagtttttccttgacctgatgctgtagggcttggcaactcttgtgaaatttcatagatctcgtcgcttactgggagtctgctatattgttgttaaggtaattcctgttataacttaaaattggaaatgatttctcctacatttgggtgatactgatgacctttattttcacttaaggtctctttgttagtggtggtagaaattggagtattccctctcatttgtggttggtggctggatatctgttccttggtaagttgagtattcattattgtataatagcataatttaagggcttcaaaagaggaagtcttcagcatgtattctttttaaaggaaagcaaatatttgataatttgcttattcttttggcatgtgtatcagtataggatcttaatgttaatttttcttgagtacctgagtttttgaggctttgtgcaaatttttgatgtcaggatagtttgggtggaatctttctaatagtggaggattttattgcccattttgctgtcgtaaatttgtgtagataatgccaagacattatatacatagagaataatttgataaggaaactgtctttgtagtaataaatttaaccctaatcatttgatttaactaatatgctcagtcttgattatactctttaattgctgttagtgataatcagtttttgattgtttcaaaaatattttatgtgtagaaaagctgcctttggttctgagataacatttaccctcccataccttacttttaaaacttctcaagaatgcagacctataaccaagaaaattttttacattcatcaaaaatagttctttaatagaatcagtattaataaagcttttactaattggtttatcattctttatatttgaagcagtagccaatcttgtatatagttctgtgacaccgtggaatgacattaagtgaactgcagttctaggaattgttccttgcatgcatattgattatttatttcctagaagatgaaaatgttaacttggcaaatgtagggggcacagatttctcttacctgtcctcttttgtctcaggaaatgtttgatgctactctgaaagatcgagaactgagctttcagtcggctccaggtactaccatgtttctgcattggctagtgggaatggtatatgtcttctactttgcctccttcattctactactgagagaggtaagtccacagggaaatgctgatgctgtacatttataaaaaggacttttgctttcaccaccagtcatgtctcaaaggctatgatgatttcctacctaaatcatattctctactattttattctaagagggaataacttataggggactttgacttaattactttaaactgtttcagttgtttgtctccataattggcaagttttaatatttctgtctgagtttgaaagacgattcaactgaggaaaaagataagagtactcattttgtcacacttcgtatatactttagccatcctctaatacagactcttggaattttgtatgatgtgagtgtgtctcagacttcaaggaactgtactgctggaaataaccaaaaggatatggttttgcaggatcagacatgtaaaatcattttgatttaggcgccttaagtatagaattacaatgagggtcctttatgattccagttcactggcctgatggattacctttatttatttatttatttatttatttatttatttatttatttatttacttatttactttttgatactgagtcttgctctgttgcccaggctggaatgtagtgccatgatcttggaacctccacctcccaagttcaagtgattctcctgcttgaacctcccaagtagctgggactgcaggcacccaccaccatgcccggctaatttttgtatttttagtagagacagggtttcaccatgttggccaggctgttcttgaactcctgacctcaaatgatccacccaccttggcctcccaaagtgctgggattacaggtgtgagccactgtgcctggcctgatacctttattagttctatgtttctaatctggttcttagtgatttgaagatgatgaaagcagttgagtatttgattagtgtacatctcaagctcagtcattccccaaatactgaatggtcactgtgtgccggacactatactgcattctggggtttcagtgagaaacaaaggcacaattcctgttctcctcgattttatagcctgaaaatgaatacagcattgaaaatgttggtttacacggagacgggtgatggagatgtgcagggtgtggaggaccaggttgacaattccagtgagaagggaacacaaaagcacaaaggctgaatgctgctcttggtgtactttgttctttgaaagatttgaggaagaggaggaggggtcagggaccaaagcattctcctgaatcatacggtataatttcagtaaattctcttggtaactaaagctttcattctttctttgaaacaactgattgagaactaaagcaagtacagaaatgtgtttcttaaaaatgtaattatatgtgaactccagattacttcattaagtgaataaaatgctttataatgatttctttcattttatcagtgtggtggtttttgttgatataaaattttaatatgtggaacttaggcagaaccttagaaatcacacactgtaaccccttgtttaggagatggagaatagaagtttgggcagattagatgcgttacacagagggtaactcagtgagtttggaccacatagaactagtacccagactcctcctttaccccatcacctgcagcctcttgggtgatgattttcatttacagggggaaggcaaatcagaccgtctatttagtacatttataaattgcaacataacccttttacgatagtaatggttgtatttatttttcgtctcagaggtctagatttcttgacacattggacccaatgaatgttttttttttcccccgcccctagtgaatgatgatgtcaaaggacatcatcagacacagggtagttttcataaagattctggtttaggaacttactttcctaagaataccatgtacattttctggggcccactttagatgccagaataattctaagtgcttatctttctgttaatgttttagctcatatatagaatttgaagacattggtgaatattcatagtatttaaaatatatttgcaggtacttcgacctggtgtcctgtggtttctaaggaatttgaatgatccagatttcaatccagtacaggaaatgatccatttgccaatatataggcatctccgaagatttattttgtcagtggtaagaagatgtttccattgttttttttttttgaattaattgtgctaacctatagttttgtttaggtttttttttccagttctcaagcaggctgatagagtatattgaataatatatttatctaagcctgtggtattcagttgtcaagtagctgtgttattggttactttgttaaaataaatatgtaaaaagatatttactaaaaggaagatacttccttgttccatagtagtataattcaggggtccctagcccccatgttttggctgggtactggtgcatgtcccgttaggaatggccgcacagcaggagatgggcagcggtcaagcaagcattaccacctgagctccacctcctgtcagatcagccttggcgttagattctcatgggagcgggaaccctattgggaactgcgagtgcgagggatccagattgtgtgctcattatgagaatctaatgcctgatgatctgaagcagaacagtttcatcctgaaatcccgttgaaaactgttttccatgaaactggtccctgatgccaaaatggttggggaccactggtatgattgattgctaaattacggttgtctgaattacgtttaatttgcattgaagcaatggagacttactactggcttgtaaattaaactcttaacagaagcatgtcaaagtttccccacccagaagaagaaattacatagttaaatctaatttctttcttttttttttttttgagatggagttttggtctgtcacccatgttagagtgcggtggtatgatcttggctcactgcaaccttcacctccctgtttcaagcaattgttgtgactcagcctcccaagtagctgggattacaggcgcccaccaccaagctcagctaatttttgtatttttagtagatgcggggtttcactatgttggccaggttggtctcgaactcctgacatagtgattcgcccacctcagcctcccaaagtgctgggattacctcacccagccgtaaatctaagtttttctaaaataaaattcttaaagtaacattatgtcctttgaaagcttttgtagccattaacatggggcaagtcttagctggttacaagtgatttattaagttgcaggcatttctgcttcctcattttaagtttccagctcattccttaggtagcaagtggtgattatcctttgtggcttccgttttagcatttgtgtcctagatgggaggtccttacaggaagaggggcaggcatcttaggaaaacatttttatacaaaatgactcaaagataatgtgtagagtgggaaccgcttgggctttgagtagacacaggcctggactgcatattgcttgagtgtgctcagaagtctgcctgtcttgcacaggagtgattgactcttatagtggtgtcataccctgtttccttctgcagattgtctttggctccattgtcctcctgatgctttggcttcctatacgtataattaagagtgtgctgcctaattttcttccatacaatgtcatgctctacaggtaagttttaaaaatttagaatagctttactaatttatctctattagggatttgatgttcagattacattaaacatttaaaacatttcttatagttactggaaatcatctgacaattaaattttgctttattttacctttatttttattattttttaaattaaatttaatgtttaaaaaattttctggaccttttccactttgcataaattttgccttattttagatcagataaacattagtacttacattttgtaaaggaagatgtttattttttctgcgcataaagtatgcatttgcacaccattgaaatgttttaccatacctaatgagagtgtattagcatcatctttattttgaaaagcacattataaagaataaagccagagttgcacatttaattattaaaaatagggtacaaggcttgtagatggaacatcttttttgctttaaaaacttaagtgggctaaggccaggcgtggtggctcacgcctgtaatcccagcactttgggaagccgaggcaggcggatcacctgagattgggagtttgagaccagcgtgaccaacatggagaaaccctgtctctactaaaaatacaaaaaaattagccatgcgtggtggcgcatgcctgtaatcccaactactcgggaggctgaggcaggagaatcgcttgaacccaggaggcagaggttgcggtgagccgagatcgtgccattgcactcccacttgggcaacaagagtgaaactgcatccccccccccccaaaaaaaaaagccatccggaaacctcccactaccagtaatctttaccactcatcctatatgctctttagggatttgtattatccccacagtcattatcccaattgcaggcaaattggattatttcctcaagtttacttctaatgagtctttaaagtattgccaattctaatttcttaaaatctcttactaatctaactcgatttgccacttacttaatttaggccttcctcttgctctccattcatccgcaacacctctgcctctagattttctagaacttggattattttacccctgtgtttaaaagttggcagcacttcctctgtaatctatgtgatatatacaccatttagaatgagatgcaagacttggcataatctcatgttgctttttcagtgtcttgtctcagcattgactgacttcaattcttttaattgtgctacactgccattgaggctcccctgattacttagctgtttgtctttttctctctgtttacaatgacttgcttgtccacgtttgagtggcaagcatttgatattctttttaaaatccagattaaggtttttaaattttattttattttttatgagaaagagtctcgctctgtcacccaggctgtagtgcagtggtatgatcatggctcactgcagcctcaacctcctgggctcaagtgatcttcccacttcagcgtcccgggtagctgagactacaggcgcaagccaccacacctgcctaatttttgtattttttggggagaccgggttttaccatgttgcctgtgctggtcttgaattcctgagcttgaaccatctgcctgcctcagcctcccaaaatgttaggattacaggcatgagccactgtgcctggccatcattccatcctttaaaattgtcttcatcgttgtatttctttttatagcatttgttacattactttacaaatatgtattgttttatcccagatggcagaaatcatgtcttatttaggtctttttctctctgtctctctttttttaatttaaaaaaatattttgtggagacagggtctgactatattgcccaggctggtcttgaattcctggcctcaagcaatccttccactttggtcgcccaaagtgctgggattataggtgtgagccactgcgcccagcctcttatttggatcttaatgctttgcataggaacatgattgttcaaaaataaaaggtttactctacacatagtaaaatctcaaatttgtattttattaaattagaattggaaaatacttatatcctgattatttaaagtggcagaaaaaatgccagtaagggtatagaaagtgggcaggatggggttacaatttaggaatagtgactggtaaagacctgagggggtgacagttgaggaaagccctgaaggagttgagagagtgagccacgtggatccctgaaggcagaatattcttgcagaaagtaggtgcagtggcacccaggtctgtttgaggatctgcagggaggcaagtttgtctgtagtaggaggaggaaggcaaagaattggccctgaagtcagaaaggtcatggagagccacctcctagagagtcttacacgacataagcactttggcttttgcttgagtgaattgaggagctcttggaaagctttgagcaaaggagtgatctaacttaggtttaaagaggatcattctgactgctgtgatgagaggaaactgggttggagtggctaggtcagaaacaggaagccagctgggaggataatgcaatgatcctggtgagaggtgagggtggcagagatgaaggggaggtagcagtggaggccttgagaaatttttaggatattgttaaggtacagtcaaaaggattctctagctgtttggatgtgaggtgtcaaaggaaggagtgaccttttgtgtaacatgctactaatatagcaagtgaggagagaaccaagacctacccatcagtttagcaaaatgaaagtctttggtgacccttatcagaaacaatttggtggagtttgtggggaaagcctcactgagttggagagagaatgaaaggagaggtaataaagacagtaagtttattagattcttaagaagttgcgttgtaatcccattaaatagtagtcatatgcaaaatacaattcacattataaatcctgcctctttcagtgatgctccagtgagtgaactgtccctcgagctgcttctgcttcaggttgtcttgccagcattactcgaacagggacacacgaggcagtggctgaaggggctggtgcgagcgtggactgtgaccgccggatacttgctgtgagtatgggcagctgactccttggacatgcatgtcatttgtgactatggaataacctttctggaaaaagtatgttccatggcccactcaagaaaaattagttttaataagagacaatttagtaatatttgcaattgcatataatacttctaaatgaaatttttttttcttattgtccatcctttcatggagaatatatacatctttttgccctcttatagaagtttgctgctggtccagctttcatggagtaaatgtcttttttttttttagtgcattaaaaacaaaccagtttacctttatttagaccaactaacttacctttatttagtgctcataacctgggaaatgggttcttctcaaatttgatttctcaatcttctagtgaacatgttgcatttttttccccaagctttatatactctatatttatttaaaagttgaatctttaaaagtttttcagtttggcatcttgtaggtatcttaaaggtgaagtacagatttggttatatttgcttgaacatctgtcgtcctctaactgcttcctcccccagtctcatttctgacctaactgatttatagcttggaggttttacaaatttatagcttgtagctacatgttgcagtagtcatctgtagagaagataagaagtttttcttttcctcctgtagatccttaacaatattgtacattgtaagtatgtacttacaccttgtgcttgtaagtacttacctcttgtacttacaagtgtacttgtaagtatcttgtacattgtacttttttctttcagttactgatttcttctcagatactggctgaagaaaacgtaaaataggttgaatttatgggatatcctacaagttcattaacattagaaaggtttgatttaaagtgggtacaaacatttagaccaaaattaggtaataatgtggtgcacaaattctgtattatacattttctacccttagtagtaaatatgaagaaaatgagtgtcatgtctgccattttattgtgacctgaagtgagacttgttactgatgtaatttttgcacagggatcttcattcttatttattgggagaccaggaagaaaatgaaaacagtgcaaatcaacaagttaacaataatcagcatgctcgaaataacaacgctattcctgtggtgggagaaggccttcatgcagcccaccaagccatactccagcagggagggcctgttggctttcagccttaccgccgacctttaaattttccactcagggtaggtgctatacagacttaatcacatatagaggtttttttggtttttttgttctccaaattgctgttgagaattggtgctattagtatgcagtcctctgtgtagacatgttccacattttattaccctcattatgtaacgtaaatgattaggtaagtttatcaaattttagagataagtcaaagagttgggattccctgggctcttgctccctatttaagaggaaaagactctagagtaattaagaaactaacattattgatacatttcaacagtgtgtcaggaactagaatgggcatttggatgttttctcatttaatctccactcaaatactgcaaagtgtaggcgataatttcatgtttatagctaaggaaactgaaggcaatattggttaagaatgtgcctattacatgttcgttagcaagtgatcaatctttgtgcacctcagaattttgtcagaaatgtaagctgatgactgctatatgattacagtgaagtcatcatttatatcaagtctgttattttaaaatgccctttaataatgacatgggcttgtgagtctgatcattttaaaacttgggcaggttatttaacctctcagcctcacatttctttttttgtaaaaatagtcattattatacctttgtagattactgtgggtcacatgtgttcagtcattcagcaaacatgtcttaagtgtctatgattgatattttcagtgtctgtgaggatatagagagcatacgtggtctttgctcagaaagagcttacagtctactcagatgagaaagacagtggcagatttgagctctcatgctggtgtttacagtgggtgctgtgactccttcaatcaagaaccacttgttcttaatatggacccaaaggaatcttcctagaataggtggtgcctgaactgtcttaaacattgagagacctgtcagagagtgaaaaaaaggaagtgggaagggcattccaggaatatgtcaggactagggcacattaggcatggtgggcttagaattgcagataagagagttgtgttgttttgtttttgagacagggtcttgctctgttgcccaggcttggttgcagtgtgcgatcatggctcactgtagccttaacctcctgggttcaagcgatcctcctacctactcagccgtccgattagctgggaccatgggtgcatgccactacacctggctaatttttatattttttgttgaaatggagttttgctatgtagcccaggctgttctcaaactcctagttcaagcagtctgcctgcctcggcctcccaaagtactggaatacaggtgtaagccactgcggctggcctaattgaatatatttagagggtgaggtgtatgtccaggagaggtgaggaacaaggggagagatgaggggccatgggagtggtgagggataaggtggggaagaggtgagggacaagaggagtggtgggagataacgctcttgaatgggcaggaaccagataatggagcaccttgagcaccctctgcatgagtccacactcactgaattgttcttctgctcctttgtccccttgaggggcatatctctgttcctgattcagtggcttattctagaggactttgctgcataaccttgaggaaagcatgaaggtcatcttttcctttatctcttaatagcagatctcatagtcagctcccgtttttcccccttggtctttactcagctctctcgcctctccgcagacaaaaaaggccttctgagcaacagttactttctggccagatcagagacagactcaaaaaatgacttttcacacagttacagctgacaaagcctcagagtctcctgggttttgttatctgtccttttcgggcttcccaccagagctctgccctctggtcttgtggagatccacctggtaagctagcaggcaagctacagttgctgcctttctgctcagggaaactggtttcctcttctctgtgtgatcactttttatctgcacttctgtattagtctgttttcacactgctaataaataatctgagactgggtaatttataaaggaacgaggtttaattgactcatagcattcacatggctggggaggcctcacaatcatggtggaaggtgaatgatgagcaaagtcatgtcttacatggcagcaggcaagggagcttgtgcagagggactcccatttataaaaccgtcagatctggtgggacttaattcactaccaggagaacagtatgggggaaactgccccatgattcagttatctccacctggcccttcccttgacacctggggattattacaattcaaggtgagatttgagtggggacacagtcacaccatatcagcttctcagtacaggagcactagtttatatggctatttacatttcaatttaattaaaattaaataaagttaaaaatttcattactcatttacactaaccacatatcaaatgctcagtagccacatgtggcctagtggctactgcattgagcagtgcagatctagacatttctgtcattatagaacattttaattggatagcactgttatttgattaaaaggtgaatgtttttaatttgtaatgttttaataacaagggaaaatttaaggtgaatgttttttttttatgctctctgattaaaacatttgccatttacttgtgggatgtatctgattatgtgagaatggatacttattttcattttggcctaaatcataggtaattttactgaaaataaaaattttatgtgaaattgcaggaaacctggcaacgcaaatatagatgatttctttttaatgggaagattgtgttgattctttgataaaatacattgagcacgtgttctctatttatgcactccttatgttttactttgcagatatttctgttgattgtcttcatgtgtataacattactgattgccagcctcatctgccttactttaccaggtatgagcttgtgctagccttcagctaatagcatcattaaggttatttatttagctatttgacagagtcttgctctgttccccagtctggagggtagtagtatgatcatagcttactgcagccttgaactactgggctcaagcaatccttccacctcagctaggtctatagctctacttaggaattcaaaaagtatagtaccatattaggaagacaatctgtggaaaaaatatactggaaatttgggtcttactgttctctctagcctattgagaagtaatcatataaagtaagttactaaattatgtaaatggtcttatccaagtgattgttgtgggatgctatagagtttattccgaacaactttttgtatgaggcactcccttagactgctctcaaatccatttttcacattccagcatattcagatagtcttaactttttctaagaaaattaatatggtattctttgattattgtgctttaaaatgttattttgcccactccttattaaaataagcttagttttctgtcttgatgaatgagccaattggaagatagttactctaaattatttgtaatgtttctacatattaaaagtattgacatcacaaataagagaagaaattccccacttttgtcctattatttgcataacagtttcatttggtgataaaaacaatgaaaacattaattccctcaaaagcttttttagacctaaaagaataagtaattggcatgacaaatcagagtgtatgtcccagtagagctcgcctccattgaacttaccttgttttggttgtgatttcatcaaattgtgtactctttagacattgtgatttttgtcttttgtttttttgatgaagacattgatatatcgaatgtgatatctttttcctaatgtgaaaatactaacataacaacatgaagatgacaattctctttacctagccacatgtctcatttatcagcttttctattttcagtatttgctggccgttggttaatgtcgttttggacggggactgccaaaatccatgagctctacacagctgcttgtggtctctatgtttgctggctaaccataagggctgtgacggtgatggtggcatggatgcctcagggacgcagagtgatcttccagaaggttaaagagtggtctctcatggtatgtgtgtgtaatacaagactgatcttgtatgttaggaatagtgaatatttttccagtcatcttaaatttttttttttggcacatttatttccttactatattgtttcaagagagttgattttttgaattagaagaaatactctttcaagatagtggctttctggttcattcttgttcagagtcctacgttcagatatatgaggtttaaaagaaaaacaggttgggcacaatggcgtatgcctgtaatcccagtactatgggaagctaaggcaggaggattgcttgatcccaggagtttgagaccagcctgggcaacaaagcaagaccccatctgtattttaaaaagtatatgtatataatatatttttactggatcatttagtagcatgtttttctttatacacgtgcatgcacacacctacacatgcttatattacttacttaagggccttactggacactttgtaacattattgctctcagtaacacatatgactcccacaaatgtaggataaaaaaaatactgtaagatgattatctgagtgcagtgatttatgtctgtatgtgtgtaatgttggctgcaactggtaactatgcttaggttactgcttacaccttttcatttgtataatcaactcttaattttttatcgatttatattttgattttgatttcattagaagtttaatatccatttaatattaatgttgaagaaaaatataaaatccatttttatagtgagagattcattatatattatggaggggtataattgctatttaatccataagataatgagacaaccatatttaaaatacagaatccagctaattccagttttcatttgatagtcttccacattattagaaagtgccatatagagaaacaagtattttgtcttccatacacatcatatttagtctcttgttgaaacaggtgtgttttctgaggccacctgaagtaaaagagaggtcatgaggatccaaggccactttaaatcattttttttttggtcagaatttcatcattactcttttataatgtctcctctctgtgtcagctttattttcattttgccatttagtccagttgctagagctgcactatctggtatactagtcaggtggctaaatggctaccatatttgacagatacagggtatttctatcagtatggtaagttctattggaccatgttgttctttgagggagccagtttgatcagctttattaattactttaggattgtgcagagccctccctgtataccagtccacctcaaagttcacagatcagcctgtgtatgggtgggccaccgttggagcaggggccttggccagtcggtagcttttcttgggcaaacagaaacctagtcctaagaactggattgtgagaaaaaaacagcccagccagctgtgtgctttttatgtaagagacttgagtacctgcagattttctggatcctaaaaccagtccccgtggatactgagggatgactgtggttgctctgttaggcatcagtctcaaacctcaaaatggaaatagagtttggctcagaaagatcctctttaatgatgtgggctcctgtttcctaatagatcatgaagactttgatagttgcggtgctgttggctggagttgtccctctccttctggggctcctgtttgagctggtcattgtggctcccctgagggttcccttggatcagactcctcttttttatccatggcaggtaaatgtatgtcttttgctcatgttatttcattaaggatttgagatcagaaaataatcctagccaggcatggggcttacgcctataatctagcactttgggaggctgaggtgggaggactgcttgcacccaggagttcgagaccagcctgggcagcatggcaagacctagtctctataaaaaattggctcatgcgtctggtcccagctgcttgggaggcaaaggtgagaggatcacaggaggttgaggctgaagtgagccatgttcatgacactgcactgtagcctgggcaacagagtaagagcctctgtccaaaaaaaaaaaaaaaaaaaaagacaaaaggaaaaaaatataatttttaattattttaggtgattttaagcagctggtttagaaagactaattttttttttaattctaggaactcttataaaattgtttaatgctctttaatctttcagaatatgcaggtcttataactcctttaaaagtgcttactttataggttaaaatgttactaaccatttagtcttctctaatacttgaaaatacaaattaatagtcattgatttttgttcacctttgaggtagggtgaattgtcttactccttttgacttggaggctttaatacttttgaattattatagcatgttttcccacaaagtcacagattcattaaaaagagtatcctggctgggtgcagcggcttatgcctgcaatcacagcactttgggaggccaaggtgggtggatcacctgagctcaggagttgaagactagcctggacaacatggtgaaatcccatctctacccaaaatacaaaaaattagccaagcgtggtggtgtgggcatgtggtcccagctactcgagaggctgaggtgggaggatctcttgagcctgggaggccgcggttgcagtgagctgagatcatgctactgcactccagcccgggcgacaagagtgagaccctgtctccaaaaaaaaaaaaaaaaccaagagcatcctgagggaacccatgtaagtcacagcaaaggtcttaaagctcatggaaaaagaaatggaacttttctattgtatttagagcctgaggtttttaacatcatagaattaagatctcaagttcttagtaggtattgggggaaaagagctaggtattgacttcagtcattcaaaggctttttagctttgtttttatctgttagtatattgcaatggatttttcagaaaatgaaaattatttggcccgtatttccctttttctgctttccagatggagaacctccacaaacttcatttacccgaaaatttttatttaagtgcttttaatggtgtacccacaccctggattgtatcacccagatgaaaatgaggctagtgcagtaattttcctgaggaatttacacactctgatgggaaagctagacaggtacacaggtgttgtgtggtgtgattaggggaagcacaaggaactgtggcattgtgtaggagagacatttaatctagctttgggagtttcaggtatggtgttccataagagatagtatctaagccaacctaactagtagagaacagagaagtgggtaagaaaggaagaagtatattccaggagggagatgggcagacctggcttgagacaaggcatgcatatgtggggaactgcctcctttctagtctggttcatagactagaataggtgagaaataagtaatacaaagaagtacagaactgacttgtgttttgatttatgactttttaactttttgatggttgaaagcgatacacattcagcagaaactgtactttgagtacttctacagctattctgtttttcactttcagtatagtattcagtaaattgcatgagatagtcactacgtaattataaaattacgtaggcttgttaggcctcagttatactacaaggcaaaaaataaaataggttttgtgttagaagtttttgcccaactataggctaatgtaaatgttccgagcgcattgtgataggctgggctaagctatgatgttcggtaggttagatgtattaaatgcatttttgacttacagtgttttcaattacagatgggtttatctggacctaacatcattgtaagttgaggaggatctaattaagcatatgttatgcctttctgtaagagccgtattccagagtagtcaaatagtatctgtaattgaaggaaagagctaccttttttttttttttttacagaaaaatgccagcaaataaaggtagagagattaacacgattagaaaaatactattttgcaatacctaacaaaataattgattatagcaaggattgttaatggatgttgaacccaacagatgaaaggttgatcagtcttcagttgctattgctgtgtaacaagttatcccgcaactttgcagcttaaaacaaccattttaattttgtccatagagtctgtgggtcagatattaagacagggcatatcactttgcctctgctttgtgctatctgggactcagctgggaagattcaatggctgggaatgatttgacagttatggatggaatcatttggctggaaacacacaactagtggaggggtcaggctgataataccctaacccagtcagtgatcacttaacagtgtgagagttgatgcttgttgttggttgctacccatctggggctgttgactggagctcctatatgtgcctgggctgcttcatagctaagtaacctcaaggtatttgggcttcttacgttgtagttcagggaaatgagtgaccccacaaacaagaagctgcatcatctttaatgaccccatgtcagaaggcctacaacatcacttttcagtacattttactgggtataagcaagtaacaaatgttggctaagattcaagggaagaggacatagaccccctaccacatgatgggaaaataatttgcaggtatgttacattgcagtgtgaaagtggttatttgaatggtggcaaagtgtcaccttatggattactttatggctcaaagggaaacacacaactagtggaggggtcaggctgacaataccctaacccagtcagtgatcaagcaaagtactgctgcaaatgggacaaacagatactatctgccttttaatgttacgcagcatgagccctggaaaaggccagagcatcccgtggcatcaaggagccatcttggcactgttagccaggccttagtgttctcctgttggacataaacaatttgacagaacatcaacatcatacactgtcactctgtgatcaagatagaggaagacaaaagcaagaccctctgcaatcatgtctgaacacagacagaacaggagcattattcaaaccacagaaatgaccaaacattcccctttactggctaacatgattggttactgcctcattaccaattacagttttagcttctgccactttttctagataagatttatttattaagataaccattcacagattactctgctttctaatagcatctgatacagaccaaattcctgcttcttaaatcctcccccaaatccctaacataagctgaaatcctgtaataacccctttctagcactcttactgaggggccccaagttctccatgatgtgttactcccttgctgcaatgagtaataaatgcaacttgttctagttatacttgtatttttggtggtctttacagtactcagcattacttctgaaatcatcatcaccttagagaattctttggtactatcaaagtttaaaaatgcttatatattatgactcagcagtttggcttttcagaatctactgtgaggcatgagcaaggctgtttctgcaaatacatcattttttatagcaaaaaatgagaagtgatctagatgtccaccaatagagaatgcccaaataaaatgtggaatatcaatgcagcaattgaaaaaatgaagtagagatatttgttttgatatcgatagctcccagacgtgtttctgagttgggggaaagcacaagctgtagacagataatgtgcagcgtgctatccttaatgttttgcattaaacccccaagtttttgaaggaacagtttgctttttcttaattcatgactttaagctacttgcctttcctgcagcaagtggctgcagctccgtgggatagtgggccagttggaattctagcagagcagctagtgtggtgtgtcctgtctggcaggagaggactgcaaagcagtgggtttttggagaacgcgaatcacagtgatcttggacctccttgggtaaacattaatctcatttgggtgtctgctggactcccagaaggccaagagaaagctgaattggtgggttgttgcatcttccctgcctgtgagaaaaagcagggaggctttcttcatgttcctcagtaggagactgttggagggctatcccaaaggtctgaagacgtaaaagatccttttgaagccctttaggatattctcagccaggcccaagcctccttgaggctgcagaggaaattataacaagtgctttatatgcaggaggcttagcagccgcagaaaggaagttaaggcagagcagtcagaacacatgccagtttgacagcactgcttgcagagccatgagcttccagagagaagaggaaatacacggacgccgagtgcagtatgttcacacgcacatacaaacagcagctctaaagcagaacgcagttgttgtggagctgtatgacatagatttcagacaaatctagtagtgaaaaaagatgtggacagtcaccactgggcttggcttggaggcttggaagatgaatgcaaagcactgggcaaaacggaagaggaaattgagaaagagaaatgttttggaggaaacatctaggagacttagcgtactgataacgggggttccagaaggaacaaatgtgaggcagcattgatacaaaaacaggagaaaatttaactgaattgaagaaagatctgattctgtagtttgaaggggctcatgagatttggtaagattgagatccaagataaaaacacgtaattgggtatatcttattagacacggggaaatcaaaacaagcttcaaaaaactgcattgtcattggactttttttctgtagcactgaaaaccataagatcagagaatttatagacgactgggtaaaagggacaaaagccaagcttcctctacccagacaaaaaatcatttagctgttcacctatcagggtgaagattgatatttgagggtattcaagaattcagtgtatgtatcaacctctcaccccatttgaagaagatccttagaataaccaatcaaaccagtaaagaaatgggaacattggcctcaagatggtagacagtgaagaggagaattaacaatctgagcaaagtccatatgaaaatgatactacatactttctatgggatatagatgtatagatgcagctgaatgcatggggaaaaacatggatggtatgtaccaaaagctaatagtggttattgctggggagggatcaggatttaaggtagtgatcacagaggactcccgtcttttctgtaaagattttggttttatgtaagaatcagtctaaatgttacatgtggtttctttttttttttttaataccgttttttgttgttgttgttttaaataagctagatagagaccaggttataaagggttttgtgtgccttgctaaggacttcagggttgttaagcagggaagttacgttcatgatctgatttgcatttaaagagatacttggtggtggtggggaagggggctgtggggagggaggaagtagtcatcactctgtctggtggagagctggagggtgggcaggccaagagtccgttgcaccatgaggaggaacctagtaacagttccccagtagaaccacaaatgcttcaagctagaagctatctgtgagcctttagaatggtttcttaggccaaactttgctccacagtcttaatttgacataaatcagctcacttgaaaccaatgaaatagcctaaagatagtttgaaataaaatcttggcatttattttatttgctttttgagatatccattaatgaccagactttctctaactcttgggaaaacaatatagatttttaaaagatagaagaacaatttttgatggaaacattgaatttgagctgttgaagaaaaaaaattctctgggttttcagtacgttagtcttttgtaaaattgttgccaatcctatagaacttctattttgatgtgaaataatgtaagaaaattatacagcctctctgctgtgtttattgttaaaaaacaacagaaatatgttaaatggtttttaattccctaggactgggcacttggagtcctgcatgccaaaatcattgcagctataacattgatgggtcctcagtggtggttgaaaactgtaattgaacaggtaagcaaaatcagttttcagagaaagacattctggaattggttgtgtttatgtttggcagctataactcttatttcttatcttcctaccttgctgagttttctacattttttttgatgggcatatataacctttttttttttttttaaagacagcagtttagttttaccactgtaggggaggaaaataatttgttctcaacccttgttttttttagttaaaatggaaccctttaataaaagacaacagaaaaacaaaagtttattaaagtacatatttcatatatacatggagatacccagggaatgagtaatttcaaagaggtggctttgaattccaacgaatcttcaacaaagaataataaatttttagagaagtgacaagatgaaggaaaaggactttgagtctctaggggtggcaagtgaggggaagcaaaaaattggcagatgcggctccttagtaaagcttggcagtgttgattcctctggtgccatctagaggcccagaaaggcccaaagctctcttcagtgggtaatctttgtccttcatggtgtagggaagtggggtgggctaccttttgtctttatacatttatattctgcttctaggcaatagagggaggacggaaagttttcctgcatctattctttctcagttgcattcaactcaaaacaatccttatgcctaagaggcatatttttagggtggcatattgtggttttctatactcccatgaattttcatcaaccacgtttaagccatcctttatctgaaggttaaccagtagcttacggtatctagaaccctgttcatagtggagacaaaaatgaaaatacgtgctttttttctggtgaaggttgatattaatgtttctaagcctgtagtagatttggagtgggggaaaggttattgctcgaggtaataaaagaagacagaggaaaaaacattacaaaaggagagctgttttggcttcatctagctacatagtacctaagactattattgtattacagaactgccagataatttgattgttgtgggaataccttggaaaaggtagactgtgctttagcactccgataataagactagaaagtatggtaattcatttaaggaaaatttctatccaaaatggccaacataacagattttgctgctactttacgctttagctatatggcaaatgtacttgtggggacccctcttatccttaggccagtgccacataagtaagacataacagttctgcagcagtaaagtacacctctttttgctgtatgagaagtaaagacagtagttagccaagcatgctcaagaaaatctgttcaaaaagtgcctgtatttcaagattttgattcttaggagtaggggggttagggagccagcaaattgcagtgtgtttgtgtgtgtctctaaagtatgggctaattctgaagtccaccaggagtgtgatggattgggggcttctggcttcatatcccttcaggatcagagtgcaggccagtacactctagaatggccaggttagcctctggcccttgaaaaaggagcatggagatgggatttattcatactggaggctgtggaacatcattgatcttctaaataatttgttatcttattcattgttttctcttgcgtatgtgcgtgtgtgtctctgtaaatttaagaaaaatggttggaaatggttgagaaacactgggatgccttgcttcattgattaaaatgcatttgggttaactaggtgtctttgggaatggcagcatgcctttaaaaggttaagcatgtttgccattcaaattccgaggtgatggggttgagttatgctacattcagtcacagctaagagaggtttaagtgctgctggtgaggcaagaggagaagaaaataacagccttctaagccttgtttctgtctgcactccatctaaattttctgttcccagggttttcccatttccatccattctttcctctgcattactcttgtagaattttctggataagatgatggaaatattctagtaattcttggacttgctttttttatattcactatagaattctttcatactaaatttttaaataccttttgatttgttaaaatttgatttatgcaagcttttcagaaacgcttcctgcttcagtgttttctcatcatactcagataaaatgaatgcaatattgtataataacacaatattacatattacgtatctctttcataagatgtatgaagttacttcaagtaatgtggtcttgaatgaataccactgaatgtcatctggtattgtatagtgcaagtagagtataaattattctagattagtgtcttatttcatcacttagcagagctaactgcagagcgttagtgggtaaatacatttcttcagaaactcgtgggcactatgcttatgttgatataccagaatttgccttgactttagaagaagtaaccagtttgactatttttgggttggcagattcagttgtgtggagattgctgtattaacttggaggaatttgtcttgtatctttgttctaattgctttttgtaatgtttcaggtttacgcaaatggcatccggaacattgaccttcactatattgttcgtaaactggcagctcccgtgatctctgtgctgttgctttccctgtgtgtaccttatgtcatagcttctggtgttgttcctttactaggtacgtaatgctggttgtggagccttgaaggagcacttttattaacattggacattctctttacccctagtaaaaaggatgtctcactccatatgctttatttgtaaatgtgaatccagctaagacaatgatttcaaaataccacttttcttagatttgactattctgggtaagattagaggatcataaagctctttgatacagttcttttctctaccagaagataaaacttgaaatttacatgctgtacaaaataggcaggatcagatttccttcaggttgtcttcttctgactagaagtgctgtgatcatataaaattaagtaacagtgttgttgtatttaagttttaaagaaatattctttggcataaaagatccaaagaggagatgctaatgggcaacacgtttatactgaaatacactgtcttgttgattgtgtagtgaagactcctcatagctccttaaacccaacatattttcaaaattataagcagagacttttccttcccaaatctttttcttctccagaattccgtctctcagcagcaaacattatcatccaacaaattgcataagtcagaaaccttgaaggctatccatgtcaccttattctgtcctccatgtccctctggtctccaagtgtcccattcttccctgaagaatctggtctctcgtctctggagcctttgctcctgacttttgttgagtcattcgtctcctaccctaactttggcaccttcctatctggtttcccagccttgaacctgccatcactaattccttctccacactgggcacaatgacctttcaaaagaatgaatctcattgtacctctttggtgaacatttttttcattggttcctctgtggcctttaatgcagtccaaccttttggcatagtttacaaggctcctccttttgctttgatgtgggcttcagtttgacctcactccatgtcatatactctgagttttgattaaacaaccatggaatggcctcttatcaaacacacaatgtcctctccataactgtctccacattttcatttgtcttatccatctgccagaaatgaccccgtcctccctttaaccgtgagagaggagcttaaaaaaaacacacaaccaaacttgcagtgtaacatgtatacttgtatgttaccttactaggtcaagaaatagaacttttccagccctttggaagccctttgtgtgtgtgcccttctttaccttttgccactggtttgacttctaatagtctcattgcttcttagacagtaaagatattagccatgtgcagtagctacttgggaggctgaggtgggaggttgcttgaagccaggaattgaagaccagtctgagcaacatggcgagacccaacctctaaaaaaaataaaaataaattatctgggagtggtggcgcacacctgtaatctcagctgccctgcaggctgatgcaggaggattgcttgaacccaggagttcagggctaacctcaggttgtgacactccaatctagcccaggcaacaggccaagaccctgtctcaaaaaaaaaaaattgctcaacacaggtttgtatagagagaggctgagcaatgtatccctcagtctgcaggatggcatgggaaacagggaacagttaagctgagggcccacagtgtgcaaactgcatcatttcctggttccttctaagtagaaacttcaaggcttttatttggtttgaattgtgactatgccaagtatcataaataccatattaaaatgcaaatatatatttcctgcaaaatatatttcaaagcccattgctttttagttttttttttttttttttttttttttgagagacggagtctcgctcttttgcccaggctggagtacagtggtgcagtctcggctcgctgcaacctccacctcctgggttcaagcgattttcctgcctcagcctcttgagtagctgggactactggcatgcgccaccatgcccagctaatttttgtctttttgttagagacagggtttcaccatgttggccaggctggtcttgaacttctgacctcagataatccacccccctcggccgcccagagtgctgggattacaggcatgagctaccacacccagcgcattgcttattagttgaatacgtctttaaaattaaattattttgactctttagaacaatctctttactggttttgtctagagtaggaatgccctattttcttttttattctaattagcatatattatgttctgcccattaatagtatatagacttaagaatttggatttccaacccagtcattcatgttttcatttttaaaaattttattgtgagcatttctggaaagactttggaagggaaaaagagtggcaaatgaaaaatgttggtacctgttttgccctgtttagatgctttatgtaattcttacatgttattcttagggtagctttttaatatgttttgtcaactctgttttagaaatgggaaattgaggttcatagagattgagaatcttaccccaaagtctggtttttaaggagtaagagcagcattcagatttcaaactcagctccagagcttatgcacagcacactattgtggtgtttggaataatccacctgacggtattaattttctgaattcctcgaaagtacttgctctgattttaaagccccccagtcccctctgccaaagaagtattaaaactcatgagttaaatatagaaaaataaatacatgtgtgttctaaaagtttgaggatttttttattatataagcacagttttggttttgcttctttaaactgtggtgcagtagaaatgtatcaatgacaccactgcttgtggaacatgagaagtcatctcgtccagttcctttttttttttttttttgaggcagggtctcactctgttgtccaggttggagtgcagtggcttgattgatctcggctccctgcaacctccacctctcaggttcaagcgattctcccaccccagcctcctgagtagctgggactacaggtgcaacgccaccacacctggctaatttttgtattttttggtagagacagggttttaccatgttggccaggctgctctagaactcctgacctcaagtgatccgcccgccttggcctcccaaagtgctgggattacaggcgcgagctactatgcctggcctccttgttttacaaatgagaaagttgggggtcagaaagggctcatgacctacacagattgtagaaagttaacagacctggggcttagaaagcttgtctgccccagtccattcttctaggggaaggacatgtttacgtttcatgtcactgttatttcacatacactgaaagtttttcttttttggttttctaggtgttactgcggaaatgcaaaacttagtccatcggcggatttatccatttttactgatggtcgtggtattgatggcaattttgtccttccaagtccgccagtttaagcgcctttatgaacatattaaaaatgacaagtaagtctggcgttctgttcgtctcttgtttaagtgttttcacttcttaatttatgtatctgatgtgacaaatcataggagggaaacatgctcagattctggatatacttggaggtgggattagcaaggtttgctgacagattgtgacatgtgaaggagagtggaatcaaggacttagttggcccaaacacagggaatatggagttgtcatttatggagctggaaaagactgggtgaaactgttttggagagggaggttttttttttttggtggtggtttttttttttttttttttgagacggagtctcgctctgttgccaggctggagtgcagtggtgcgaacttggctcactgcaacctccacctcccaggttcaagcgattctcctgcctcagcctcccaagtagctgggattacaggtgtgcaccaccatgctcagctaatttttgtatttttagtagagacagggtttcaccatgttggctaggattgtgtcgatctcctaacctcgtgatccacctgccttggcctcccaaagtgttgggattacaggtgtgagccactgcacccagccaagagattttttaatgtccattccaaatagtttttcagtctgttttcaaatgttctggtctgacagtatattaaacagttttagataaaaataagaagcctgcattagaaactagcagtgcctgcataagcccctcttgcttatagagggccactaggttactctgaggttgcacagagaggcttgagggttactgcaaaaatgttgtgggactctctgttttgaggaaaccattgaaaactctgtcacttgatctcagtgagagattgaggaaagccaaggaaaacaccttcctgggataatatttgacctttatgtccgaactgtaggctgaatcatctgcttcaatgggttctagcagagaaagtgagtttatggtttatccatctcagtcggccaagagagtcccagtttatacctgctgcctttgtgtcattaacactacccccttttacttgtgcttgtccccccttgcacaacaaattatagagttaccttatttattctgaggagtaagatttttgagaatgaaatttatagtgttcaagacttctccaaagcatttactgacagtaaaaaatacaagtacacttaggcagtcagagtacaaaggactgtcaactgaaagaaggggaaggggtattttcaatgatgaaaatcaacttcttagcactcaactttttggcagaggagtaaatactgcaaacagaatgacaagcaagacgtgccctcagggaactttctacctgcttctttctttatgctggatgcctgcctttctgcaccctgcccttctcagcctttgccaggggtctagacgttcccattgacctcttctttctcatgctctatcttcttctgctttttcctgtagcccagtgtcctctttcctcttttcccatctgttcctttatgcagaaaggtgttgaactgtagacttaagtgagggcatgtcttgtcagctgttgtatatgtactctttagcacagggtttggtctgtgggaggtgctaagagtgagtgagtgtgtgtgtgtgtgtgtgtgtgtgagagtgtatgtgtgtgtgtggtgggcttgagtatgagagagtgagtggtggtggaagagagggagttgggttcagagtctcctttctctgccactgaattactctttggacttgtacaatttaacttggtttctgtatgctttttatttacttactttgtcattgccataatgctgaccatatttttagtgtatcttgctatttagtcattactgtgtgccaggtagtgctgtgtatattttagtagatattgctcagccttcactgtttaaaatatttacaaaattctcaaagttttaaaatcagtggttggttggggaacagtggggtaaggaatggctaacttcaagaaaagaaggtaagacaaaagaaaaggaataaaacagtgacattatggataaagatgcagtaagattagcgtacttttaaaaaagtgacatattaagctactggacataaactgccaaaatatttccttaggcttgtgtgcatttacagaaaagtgatagataaaagtcaaggtagagaaggtactggtgaaaagtaagagttcccacagtgagcccttacaacatgctaagcctttgtcaccgggctgcatacactttccctttcttaaaacaatgctgcagcgtgggactgtcggtctcatttcactgatgagtaaatggaggaaagggacgaaggaaagctacctgacagcctgtcatgtgcaggtttcactctccctcagtctccttcactcaactctgtgggcttttactggacattctccctgatctgcatctctgcctccaaatgggtgcccttcacacttgtgcccagccacctacagcttgttgctttccagctttgtccctgctgtcctcttgggatcagcctgcaagccatctgctcacattaagtaaggcaggccttcagtgagccttcgatgcagctgtcgcccttccctggcattggagatgtctgtctccttgagtaggatctcctgccctgtcactccaactacagtaacatctgccttgtttctgcagccctgtggcctttgccattgccttctcctttcatcacatacataagttaggaacacttgccattctgttgttgaaccatattctcccacctcctgtcactcatactcactcactgcaatgctgtcttccctttgacttcactgaaatttctcctttgatttctcctttcttctctgtaactagaacttccagttttactttcatcccttcctactttttttttttttttttttttgagacggagtcacactctgtcacccagactggagtgcagtggcacaatttcagttcactgcaacctctacctcccaggtttcagcagttcttctgcctcagcctctctagtagctgggaccacacacacccagctaattttgtatttttagtagagatggggtttcaccatgttggccaggctggtctgaaactcctgacctcaggtgatccactcgcctcggcctccctacgtgctgggattacaggcgtgagccaccacgcccagccccttcctagctttctgatggtcatgtttttagtctgtctccttagatctgcccactaagttgttttataaaatctgaaccttaacagataaatccactgcataagtttactgtatccctcctggcctccacaggtctgagtttctgagaccccctaaaccactgactgaagcatgtcctccattgcacagcattggaggccttccagcctgtgctgcttctgcagcttcctacaaacccatacctaggtagatgtgtcagcctttacaggtgttcactcgggactccctttgacttgcccaaccattgacgagttttaagtaggagttagatttaaaaagacatatgaatgttttactctgtacattcatagaagagagtaaccaccttgtttttgcaacctaggtaccttgtgggtcaacgactcgtgaactacgaacggaaatctggcaaacaaggctcatctccaccacctccacagtcatcccaagaataaagtagttgtctcaacaacttgaccttcccctttacatgtccttttttgtggacttctctctttggagatttttcccagtgatctctcagcgttgtttttaagttaaatgtatttgacttgtgttctcagcattcagagagcagcggtgtaagattctgctgttctccctggatcttctgacattactgctgtctgagatttgtatatgtgtaaatacaagttccttgataccctaaaaccttggattaaacagaatgtgcattgtacatctttaaacaaaatgtatattaatttattaaatctagttgtcactttattttggacctgctgtgatctcgacaggaaacgtgccacagagcagtagtgcgcaggcaagacttttcagtgacgccttgtggaacgcagttcatgatgtcctagcagctctcactaagggaactgtacattctttctttcttggctattcagaccttaccaagaacgttaaaggaaacaagtagaaatcagcagtggagtgtctgtggtaagaaaacatgaactttatgcttcactgttagttgtttgtggaagttattttgtataacaccaaagctgttgtacatttcctactgcctgatttttttcatgtgtctgtgtttgtaatattgtatagtatcttgtgctaggtgaggaaattatttttaattttgataatttaatattcctagtgtgatcagcattgggagttgggtttcagtggggcatgtctatacttagagaaaaaaagtccaaatgaagattttcatgagtcagcccccccgcccgcccccaccccacacccacatcctctcttttccacacacaactatctgtttattttttgtagcagtggccgaaagtcctgcaaggtcataaatctttcagagtgacatcaccaactgtactgcatcttactggatttaggacttctgagatgcttgtgaagtatagatgtggttgtggtcttagattgacagcattagagaagactggttagaacatctggtctcgctggttagtgcctcgttggctgaggactaggtgtgcatttctcctagcttttcatcaggaaatcccaaagtttccaaagctttttgtttacagaataaaacttcaaataaaaccaattcattatttgtccagaaggaagcttggctgagctggccttttaacataggaatgtatttcgttggaaacattctgaaaaatctcagagaactgaacccttacaaactttgttttccctcataaccaaagcttcaggttagaagtttagaaaaatagaatggttgggtacatgatctaaatgtttaatgctaaaggtatatcgtaagggtagtgtttgtttttgaacgataatttagaagttctcatagaaagcgtataacataggtcttcagaaactataaaagaattttcatatagtattaaaatccatagactaaaatctgagaattttttaacatatgcaagtcagccaaacataagctaccaaaataaagagcaatgtgttctggctgttttatacttcaacaattttttccctaagtggtaagcaattactttaaaacatatttttaaaaacatcggtatcgggagctgcggtggctccggccggttgtcctggcacacaaggaggcgaggctatgcgttcgaggccaacctaggcaaaattggaaaaaaaaaaaaaaatcagtatcagaaataatgcttgacataggattcagtgttatactctttggcactttagagcagccttttctctcatttgaaataaggtctttgttagccctacctttactcagaaatttagtcctactataaaaaattaggattttaaaatataatgctgcctgtcatagtgtatttctaaattgctctctttgggagaaaaacattattattgaattgagcatataactatataactatataactatatatatatatatatatatatatatatatatatatatatatatatatatatatatatttttttttttttttttttttttttttttttgcccccgagacagagtcttactctgttgcccaggctggagtgcagtggcacgatcctggttcactgcaccctctgcctcccaggttcaagcgattctcctgcctcagcctcccaagtagctggtactacaggtgcgtgccaccacacctggcttattttagttattttagtagagatagggtttcaccatgttggccaggctggtctcggaactcctgactgcaggtgatccgtcctccttgggctcccaaagtgctgggattataggtgtgagcccccacgcctggccaacttgattatattaattttgggttttttgttttgttttgttttgttttttaatttttcaaagaatttgtggatcttggtataaagtcattggaacatatctgttttaacagcaagagatcctaggcagatacttcaaaaggttaaaaattcttaatcctacagaattttaaatgaatcttatcaatgttttgtaaacaaacaatatgaatggccaaaaaattgccctccattttactggcaggtaatttatattgtcttacttaagaattctcccctagtttttcaattgtactttatcgtgttgttttcaatgagataagtattttcatagggaaagcattttccagcataatatttgcttgggtagcatccgggttttagtatttaaccaagagccttttaaatattgaaaacccatagttcagaaaatgttagtattgctgcccttcttcacataaatttttttttaaattatactattattttgcttaattttatattgggttaaaacaaccttcaagaaggttaactaggaaagaagacctttttgttttatttttactatttatatatagaagacaaatcagcatttggtgatagttttacatgaccagttatcaaacggtcatagtatgaagtgtgcagttgttcattattagtaaattatgtttgatttttaaactatttagtactaatagttgagatgaaaactgaagaaaaatgccaatgtgacgtttgtgtatagctagccttaaaaaacttcccatgtttttaggtgacttttttccccctcttagtactctggagaaacaatgaagatgggccatctcaattccagatgtaaacaaaaagtaatttttatttcaacatttaatgtaactgctattattgtggattcttgtcttgtgtattttctttcccttattcaagtaatatagaataactttccttaaaatgatttgatccaagatacgtcatttctgtattggcaaaatgccactattaaagtgtaattcttgaatttaggttgaattgatgactttttaaaacaaaacaaacactggacagttctacattgtattgcgtttgcgaatgtgcgtgaacacacgcacacgtgcaggagaatgtagtgccataagaacactggcgctttttaaaactttccaagctagctacttattttcattttcagggttgagtactctaagctctctacttactgtgagaagttttctacattgtaaaattaaaagattatatttaaaatacttctttaggatgttattcagccatcaaaaaaaaacccaactaaaatgtcttaccagtaaagtattattaaaagcctcatttgtggagattcgctgacttccttggttaagctgtcttgtatttacttaatttgtcccctcaaccaggtgttttcttttcagcctgttactgtcctgtgccatttttaaaaatagccatcatgagtaagggcttctttaaaataatccctgacaatatctttggcattaatacgacataaagacaagacagtatatgtatgttttcattcctgttttgtacgagtgcctcattttgtagtcatgaaagtaacatagtaccttaaataaaaatgtaatgactaatctaaggtctaggaataactattgtagaagctaagtagaacacttagtttggggtgtcaattttctatcaacgcaaacaccttagggtacccagaccaattttatgtatatatattctgaaatgctccctttttaatgtggtcatttgttgccttctaagttgagaggacaaaactgaataaagtgaatgttaattgtagtctagtttttttgtttgtttttgtgttattgcaagattgctttaagattgcagaaatatgcattattagccagcatagataatccagatgttataataggaaggaaaaacaactccagttaaatgtgactgtggcgactcccttttatgtatacatttaaatgcatagttgcagaggacacatccctccccttctgtctccctaacttgaactgtagaccgtcctcactgggaagagtaaggccccacattttgtgcaatagcaagctactgcccacttctgcatgtctgctacgagatcagaaagtcagtttcactaaggttgtcttttagctgaatacttagagtaaaaccaatcaaatccattgtacatacctgaccatatgtcccagataaaaaggaaagacttgcgtgatgtttttttccttctgagtgccctgaggagatccttttgcttcagactatttctaatttttctttgtttataggttcagaattttttccatgattgttttcccccaaacaagtgcatttttaattactttaaatgcaggggtgatagaggaaatgctattcgaaccatagacatctttaatctgtgaagctgaaatttttcagcaaaggaaattgcatggtcaagttcagaaactggccattaatttcccccttccgctccacagttcatagctactcttgttgcaaacatgtagtgataaggagaactaacgtatcaaggggctgagagggtaacgttcccctcctcctccatgtttttattttggtgtctgttttgtttctagcactgtatttagtactgtagttgaatgaggtatgatgtctcccttcaaggaactcagaatggaacagaagcatgagcaaaagattgtattacagaggtatgaataaaatgccatggggaacacagagaaaggttcacccgggagagatggcctagccacttccttagtgactgtttggtatatgtaggtccccctgccattactctttcagccttctgcaatctagttctacttagtcacacacttctctaagaccactcatacgtaaacactacgtagaggcccctttttgcctcattttacattgtttagttatcattttgaaacttttcttcacatatgtaacagtgccggagtttttctgcttctctgtgtttgttcagtaactcttctttaggatacacctaaagatgagaagcttcatacccagtactcctcttcattcactcatatgtttttgggatcagtcccttctgctggctgtgcattggtctaatggaacagaatagagtccagaaataacccaacatgtatgtggacaactggtttttgacagaggtgcaaaggtcttgaaaaaatgatgctggaataattgggcatcagatgcaaaattaaaaacaaattgatccatatcttaacactggcaaagattaaagtccaaatggattatagttccccaaaactgtataatttctagaagacaacaaggaaaacgtgttcagccttgggttaggaaaagatttcttaaatccaacaccaaaagcacaatccatgaaggaaaaatcgataaattgtactttatcaaaattgagaacttctctttgaaaggtaccataaggagaacaaaaagacaagctgtagagtggcagaaaaatatttgcaaaacatttctgataaatgagttgcatctagattacataaagaagtctcaaaactgaacaagtaaacccattgtttacttaatcgctgtttctcctgagcttgctgcctctgcccctgctctctctccttttccatttgttttcaacattgaatccagaatgttcttcttgagatccaagtcagatcacaccaaccctcagaactctccaatagacgaccatggcactcaaaagtccacaatagccttcaatgctgggcaaaacatgaagcaccccttttctcccttctctgaccccatcacctctgtgttcaccctgctcctgccgtcctccctgcctccaaaacaggtcaggccttcgtgcctttgcacttactatttgcaatacccaaatgttcttcaggctctttagcctcttcatttctttcctgaagtgtcattctcactgaggcttatctaaagctgcagctactggggcattcctgtctcatctccctgctgtattttgtactcccggctctcttttgtacttttaaacatactatatggtttacctttgttgtttatatttgcatgttgtttcccacttgaatgtaagctccaaagattttatttttttaaactgaattattactgtattcccagaacaattccctggcaaatatttggtactcaatagtaatgctaagttagtaaataaatgatgaatttagaatcaaaataatgtgtctatggccaaaataaaacctgaaatccctgtcctatttcccagaggtaactgctgttaatagtttagttgtgtgcttccagacataccttcacagaatcatttatcacaataaaggtgtcatactatgcagattgtttgacaagatgctttttttcactttacacgggcatcttttcataccattgtgtggccaggccatgatttgttttccaaaagacatttacccaatttatatggtgaagatttttgtccatattactttttatagtatttctgtagggtaagttcccagaagtaatattgcacgatcatcgaaaaattttagtgttacattactgccccataaaggtactaattaacatccctctcaacaacatagaagattcctttttttttttttctttttttgggtggaggggggcggggacagagtcttactctgtcgcccaggctggagtgcagtggtgccatttctgctcacggcaacctccacctcccgggctcaagctattctcctgcctcagcctcccaagtagctgggaatacaggcacgcgccactacgcccagccaatttttgtagagaagggggtttcaccatgttagccaggctagtctcgaactcctgaccttgtgatcagtgctggggttacaggcgtgacccaccgcgcccggacggatttcttgttttcatactgtcatcaactttaaatacaagtattttcagtttttgccaatgctgttaatttagaaatgtgtatgtatatattgtctggtgggtgtttggatggaaacgatcaaaatcgggcaacttccccagtttccttgaagggagtgcttgccatcggcccctctgggaagtagctctccgtagttctccatcttcctgttttgaggaacgcaggaggaggtggatctggagtctcatccattcggtggctgttaacggcaactgcagcagccagccaggtcaccccctaaagcaaagttaaccccttgcatggtgccttggtcagcacccaccaaattcgaggtttctcctatccttcgactcgaggctcttttgacagatgtgatttatttcctcctagagccagtcacattggctcaagcaacctatcgtaagaaaacaaatacaatagtgttttagctggaaactgcccactgtctaagcggctttttaaattaagaactcaggttcactacgggatggcttaggccagggaacagcatgtgcgaagttcgaagcccgagaagtttggaggagcggccccaggcgcaggcgggtcccgcagcggggcccgtgccgcccaggcgatcagccccttcacttaacccgcttccctcctagcaggcccgagtcccctagcctcagcctcacgcagccagagcaaggggaagagggagtccttcgtgagttcgccgctcacattcggcggtgggaaaccgatccgaagatgcttttgtaggcgaaacgctcagctcgcgcggctctgaaccaccggggagcagcggctgctgctagtcggactacgccagcacctccttgtccagcccgggagcagccccgcctcgctcagggccgcgtgcgcgtgcgcggctccaggggcggggcctgctcgcgtcccgggtgcctggataccgagcgcgtccgtagtggcggctggcgctagggaactgcagggtctagggtgttgtcggagtggcagttggtccgaatttctcccgaagcccgcggaggagcgggtaagagccccgcgaatccggccccaacctcgggaacgggatgggaggcggccctggccgcaagccccgcgctgctagcgggtccaccgcgtcgtagccgacagccgcccttcttcctcgcagcgcgccgcgattcaccagcctggtcccttctgcggagagcgatgccgcttcccgacaccatgttctgcgctcagcagatccacattcccccggagctgccggacatcctgaagcaattcaccaaggctgccatccgcacccagccggccgacgtgctgcggtggtccgcggggtaagcgcccttggcccggggagctgtccggtctacatgcccaagccagacgagcccagagagccctcctcccggaccaggggccttacgcggcactcagcgtccttaagagtatcaggcaaaactttccccttagcattggtgacatctatacttgagtgttttatctaggaaccatttcgatttatcgactatgagacccgaaatcattgcaaaatgctcacttacctacaacgtaatggcaactcaattgtttaaaagtgtttatgatgaagatagactaaaacttaacaaagtaattgcattgggcaaaaaagtgtttacattatgttaaaaaaattacacggttgcagtcactttgtgaaatgactttacaaagaggaatattttagctaagttcctcatctgcagagagtcctctcagagctatgtatacccagagctggttaaatttattagaaccggaacgaccgtggtcatactgaggtcatcatccctagagtgctcagggtaaactgtccagcaaatgaagcttcacagtttattttttgccacaaacattccaacacttgccaggaacagacattcataatctcaaagttacaagtcaacagatcttagaggcattaaaagaaatcctcttggttttacaggagagctctttgccccttttcaataaacagatgtaaaacaaaaactcacttttatgatgacaagagtcagcacaggtgtaaatttaatttaaatattttagtcatcaacatttcaaattttggctgggcttggtggttcatgcctgtaatcccagcactttgggaggccaagctgggaggatcacttgagcccaagagtttgagaccagcctgggtaacacagcaagaccccatctgtattttttttaataagaaaactaatttaaaaagaaaaaaaacagccaaattttgctggctttaaactctataaccaaagtgaattagtttcgtttggctgctgtaacaaatcaccacaaaacttgacagcttaaaacacagacatacatttgggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcccgggcgacagagcgagactccgtctcaaaaaaaaaaaaaacacagacatacattcttgcagttctggaggccagaagtccaaattagtttcactaggctaaaatcaaggtgttgacagggctttgctctttccagtggttctcaggaaaacccagctcgtttccttgccttttctggcttctagagctgcatttcttggacgccttggctcatgtccccttcctccattttcaaggccagcatcttcaaatctccctctgcctccttcttccaaggacactggtgattgcattcagtggccatccagatagtccagggcagttttcccacccgagatccttatcagtccacaaaatccctgttaccatgtaaagtaacattcccaggttcctggaacatggacctggatacctttggggctgttattttacccaccaactgagctacttgtccatccagtgcttgccttctgagaaatgcttttatcaatggtttctgaaagactctttcaaagttcttgctaaagaaatatagcctctggttttaaccattattcaagcttaaataaaaggatttataagagtttgtgctgtacaaaaaattccaagatttagcaacatcttcttggaacattaaactatatttagtaataccttagagatagttatgttaagcttcactttgtttatttatttatttatttttgagacggagtttcactcttgttgcccaggctggagtgcaatggcgagatctcggctcacggcaacctctgcctcccgggttcaagcgattctcctgcctcagcctcccaagtaactgggattacaggcacttgccaccacacccggctaatttttgtatttttagtagagatggggtttcaccatgttggccaggctagtctcgaactcctgacctcaggtgatctatccacttgggcctcccaaagtgctgggattaccagtgtaagccaccgcacctggcctaaacttcactttaagaggcttaatcaggctgggcatggtggctcacacctgtaatcccagagtttgggaggccaaggctgatgaatcacctgaggtcaggagttcgagaccaacctgaccaacatggtgaaaccccatctctactaaaaatacaaaaattagcttggtgtggtggcacgcatctgtagtcccagttacatgggaggctgaggcaggagaattgtttgaaaccgggaagcagaggttgcagtgagccaagatcgtgccactgcactccagcctggatgatagagcaagactccatcataaaaataaataaataaataagagacttaatcaggaactttccgaatgtaccatgctactaatttctctcaagagccatttatttatttattttttagatagagtctttttctgtggcccaggctggagtgcactggtgctatctaggctcacggcaacctctgcctcctggttcaagcaattctgccttagcttcccaagtagctgggattacaggtgcgtgccaccacgcccagctaatttttgtatttttagtagagacgggggtttcaccatgttggccacgctggtctggaactcctgacctcaagtaatctgccctcctggcctcccaaagtggtgggattataggcttgagccaccgcgcctgaccaagaacaatttgtgagtttaggagaaaacccaggtattattcattcggcagtatatatgtaattgtaggttcaaatatgtttcagctgtcacaggacagaatctgttagggagagctattcaaaagtaacttgagtaaggcgggacttggtaagtgcaaaaatgaagggtcacgaaagttaagcaaagtagtggcttggtccttgagagattttgtaggcagagagattggggcttgggtggggtggagaggattccaggaagaggaagcagcacaggaagaagggggtggagacaggaaaaagaaaaaccatcaaaaccaaaacaggaaaccaggatacccacggacataactgctatagaacaagcaagtaggctgagcacggtggctcacacctgtaatccctacattttgggaggacgaggcggacaggttacttgagctcaggagctcgagaccagcctgcacaacgtggcaagaccttgtctgtactaaaaataaaattagccggccatggtgatgcatgtctgtaatcccagctattcaggatgctgaggcagaaggatcacttgagcccaggagttggaggcttcagtgagccatgttcacaacactctactccagcctgggtgacagagcaagagcctgtctaaaaaagaaaaaacaaacaaacaaaaaagatgaagcaagtaggcattcctctttcctcaggttagggttcttttcaaaggtgcttttcaggtgggcaaatatcaaagatgagccagcctccccctaagcctgtggactccactgtgaggggagtcggctgttccttatgacaccattgtgcagttgtgcctcacacaggacaatgaacataagaatcagtcaagtaatagaggctgctttggttggcgtgtgcctcaaggaactggcagaggctaacattagttggtctcacctcaaaagcaggcatttccagcctcggccctactgacagttggggagggcacaggaggaaggggcatcttgtgcatgatgggacttagcagcctcctggcctgcacccactggatgcctggagtaccatccaccctctgttgtgacaatcaaaaatgtctccaggccgggtgcggtggctcacgcctgtaatcctagcattttgggaggctgaggcgggttgattgtctgagctcaggagtttgagaccaccctgggggcaacatggtgaaaccccgtctctaataaaatataaaaaatcagctgggcttggtgatgcacatgtgtaatcccagctactcaggaggctgaggccggagaatagcttgaacctgggaggtggaggttgcaatgagctgagatggcgctactgcactccagcctaggccacagaacgagactctatctcaaaaaaaaaaaagcgtctccagaaattgccaaatgccttttggctggggaggagggtggcgggtgggggaaagaggaggagcattatcccccactgagaactctgcctccagaggctgtatctagctcgggattccttgcctgagttatgaggagttacccccatgaaataggtgaaaaccttgattagtaggaatgtggcaaaacgaggcacctattcttcacccacaccctttaggtctttaggttcacatttgtctaactcactgctgccttcaaatcattaacaaagccacaaaatggagctgaagttgtcttacaaagcaaggaaacaaagtcaaatttgaggggtgtaaagagagagaaaggatgagatatgaagtttattttagtctatcagatatcgacttatccatatttatctgtagcaatgtttctaactacccatggctttaaaattgttatctgtggccctggtggatgctttgatgttcatttgcctggatatgctgtctcttttcatcatgctaaagtcattagggccccaaatgatgtggcttcagcatcgccacctctggcaaagataccaaggggcgtgagtttctcagaaggtcttgcctggcacccctcccaccacgagccagaggctgggtgtgggttccctcttgacttattgccccaacagtttcccactcttgcccccaacataagcagcaatatcagtgtcccagaaaggaacaattaaggggaacaataccaggcaggaaaagtgggggtggggggatgggagccaggccagcacctgccattcccagtgtggaagtaggtgacctgtgtgttcctgggctgcctcagggttgaatatgcagagacgcttaaagtcaagcacctcaaaaagcagcaagaccaaacccacctgtcaaaagtgggaagacggccaggcacagtggctcacgcctataatcccagcactttgggaggccaagctgggaggatcacttgaggccaggagttccagaccagcatgggcaatggaacaagaccacatctctgtaagaaataattaaaaagattagccaggtgtggtggtgtgtgcctgtagtcccagctactcaggaggctgaggcgggaggatcccttgagcttgggaggttgaggctacagtgagccatgattatgccactgcactccagcctgggtgacagagtgagaccctgtctcaaaaaatttaggaaaaaaaaagaaagaataatacatggaactccagctgattgtgaagtggcagggaggaggggaagaatcacacatgttgaaggagcttctgcgagtgccagccactgcgccaagcccttctcacacaatgctccccaaccctccaacagggagtctcattatcccctttgccaacagagaaactaaggcaggcagagaaggttaagtcagagaaccaagtggaggaaccaggacataagcccgggatgttggtcttcagagctgtccttcctaatcaccgttgttttggggggttatttaagaaattggatcgcatagctgttttttgtgtattgatgagctttcagagatgtctgttatttattagctatttttcagctctgtcgagaggagatccacttcctgtaaaggacagaatggaaatgcccacggcaacccagaaaacagacacaggcctgactcaaggactcctgaaagttttgcacaagcaggtatgggggggcgtagtctctggcctcaggcagctggcctgtgctttccttaccgttcactgtgcattgatgacagagcggggcacaccccagcaatgtatttcaaacctcctgaggtccctgaaatcctgctttccctgccacgcatcgtcaaggttgattcaaggaagaaatatgttgtgtctgggaggtctttttctagcttcaacagccccaagtcactatccaggggtagagtttagaaaagtgaaatataatttcttttaaatacaaaatttacatgacactagattctgctgggcaaaacatacaaaatttcagaacctggggggtttccagtccgttctccaggtgtgtgtttgtgaaagctgtgcgcaggcctgagtaagcctctgccttctctgtctggaaggcggggctggcctttggcccccaaggtgggcagcagcctctggtgtccagtgctgtggagagcctgggcccccttcctgccttgcgcttctttgccccacacgccatcctgtttttacagacgtgagttactagaaagtgggtcacggagcaaggctaggccttcctcatgactcggttcttttgctaaaagagacaccagtggcataaccttgattttcaaactgacttatccccattctacactgtgaagtactgtgcttctgcgcaggatacagtgaattctgaaactaggactaccttaagggaagcaaagaactcttgaatggtgtagcttgcgaaaagacatgctgaaattgctcaaagccttttcatccaggatactgctagcagattgcagaagttttcagttttgatagattgtttaaaatagtagaaggaaggccgggcatggtggctcatgcctttaatcccagtactttgggaggctgaggcgggcagatcacttgaggtcaggagttcaagaccagcctggccaacaaggtgaaactttgtctccaataaaaatacaaaacttaacagggcgtggtggtgcgcacctgtaatcccagctacttgggaggctgaggcggaagaattacttaaccctgggaggtggaggttgcagtgagccgaaatcatgccgctgcactccagcctgggcaacagaatgagactgtccaaaaattaacaaataaatatataatagaagaaatacatttattttcagttttaagatctctcctatctaactgttaatgtgattaggggctggatttttaaaatgttttttactgagctttattttttattgtgaagcatttcagacagatagtggagtatcgtatactcaatatcagtatgcctgtttcattaagtcataacatgatgccgtattcgcttcaccgtccttttttcatttaataaataaaaggttgccgctcgctgccttccctgccttccctccccagggctgacagaaccccctgtcatgcatttggagttcatctgtcccctgcatggggcgggttacttggtgtgtgttgaatattcacagcattcattgtttcccaggttttaaaacatacataaattgtcatgctgtgttttccaaacagtgtcaccacaagcggtatgtggaattaacagatcttgagcagaagtggaagaacttgtgcctgccgaaggaaaaattcaaagcgctcttacaactggatccttgtgaaaacaaaatcaagtggataaactttttagcgcttggatgcagcatgcttggtggggtatgtacctataaacagcatattaataattctgtgtcatcatggtcccagcttaaaaataatttaggtttcagtaactaaaggaaacactttagtaactttgtcttagaaaagcatttccccctgctccaggcctattatattaatattttcaggtgtacagttattttaatttacagaaattatttatgaatgcctcaatttaaaagttaatagtagatgaaagatatggatactattaaaatatatttaggttttagaagaaaatgcatcaatgactttttaaaactacaaatcattttgtaaactgataactgttttgctcatctgtggaaagaggcatacaattattttctactttagtagaaatctattattattatttatttattcattttttttgagatggagttttgctgttgttgcccaggctggagtacaatggcgcaatctcggctcaccgcaacctccgcctcccaggttcaagcgattccctgtctcagcctcccgagttgctgatagctgggattacaggcatgtgccaccatgcctggctaattttgtatttttagtagagacggggtttctccatgttggtcaggctggtctcgaactcctgacctcaggtgatctgcccaccttggcctcccaaagtgttgggattacaggcgtgagccaccgcgccggccttagaaatctattattaataactaatagatacagtgagattttgctgatgtttgagtataagccaagcaacttaggaataagacatgatcctccaggtgacgaggcgagcctgggaggtcggggcgagaagggagaggttggagctgggatgatgttggcagggcttcctttgcaaacccagagtcagtcttctcagctaaagtcttgctgtgagacatggtggttgggtgaaggaagagtaaccaggcatctgccatgtgaagcttatgaagaaaggaggcagagaaaggagaaccagctccctttactacatagatgaacaatttgattttcccccctcccttcagtctgtggccccagtgtgtataactggtccttgcttcacagccctcactcagctttgctccatgcacagagctctttcattccattttcattaaaacaaattacttgaaatgggtggtggtaaacacccgcaaggctacccaatgtggccactaatgcaccaacagtcacttccaaccacctgtggcctcctcccatgtcctgtccccctgcctggtggcctgaagcaatgacatttctgaagttcctgcttctcgcttcctgacctctgaaacacatgcttctatgtgtcccgcaagaggtacactgtggaattttagttggttttgacttgatgaaaagacatttgtgttgtcagtaattttctgaaattttcatcctaaattatatgactagatgtattcatctgtacatcacaggccacgttgttcattcccttccttcgccatgtcacatctgagtgtggcgcagttcaccagctctgcagatggccccagtgggaagctccgtgccctcagggagtcgggtgtggtgtggctgtagaatgagcaagagttttgttgtgtaactgctcaaaggcaatggaggtgcttcctgtcagccccgggctaattgtgccaaggcctggatgttggcaggcatggtaccctccagtagcaaggacaggtgcagatggcaccaggggagtgtctcaggggtattatcaagatagacaaaggcaaatacttttaattattggagacatttttatgtcactttgttaatctggaactctgtgaaatctatctatctatctatctatctgtctatctatctaatctatctatctatatctgtatctagctatatgttttttgagatggagtctcactgtgtcacccaggttggagtgcaatggtgtgatcttgactcactgcaacctcccaggttcaagtgattctcctgcctcagcctcccgagtagctgggattacaggcatgcaccaccatgctcagctaattcttgtacttttagtagagatggggtttcaccatgttggcctggctggtcttgaactcctgacctcaggtgatctaccagcctcaggttctgggattatagattacaggtgtaagccactgcacccagcctaaagtatatgtgtgtgtgtgtgtgtgtgtgtgtgtctgtgtgtgtgtgtgtgtgtgtgtgtatttttttttttttgagacagagtcttgctctgtcacccaggctgtagtgcagtggtgcgatctgggctcactgccacctccgcctcccaggttcaagtgatttccatgcctcagcctcccaagtagctgggattacaggcatggacctccacgcctggctaattttttgtatttttagtagagacagcgtttcaccatgttggcctggctgatcttgtactcctgacctcaggtgatctgcccgcctcggcctcccaaaatgctgggattacaggtgtgagccactgcacccggccctgaaatcgatatgttaacaatataaaattgtatgcaatgtttgaattaatgttggtggtttctgcctctaagcttagttgtaaaattttgattttaaaatgatgagaaagtagaataattcatgtttttggatccatctttatagttttcaccttcctaattgtgaaaattaagcactagatttaaaacacaattgaatctgatttgaaaaataaggcctcttgtccatgtagagtgtgtgacactagatggagacattgtgttaaggatagagcttggccgtctaagctgactcctggggaagagacatcacaaacagcacacattcttttgggttcttcctatcatagagaataaattgacaccaggaatcatgctgtgcatcactgcgggttcctgcctgtctcctgacttgagccacctttgccagcaggactccagatttgcccttgactccttccataggtgctggaggcctctcctggttgtagaaagccacagccaccctctgctctggtccagtgcggctgtagactcagggtcaggttcaagtgtggaagctgacctctcctccctcagaggagcgtgtgctcgtctggggtccatgtctgctgccagggatgcctgctctgccctggctcccgcggcccacagagtgctgagcacgagttcaaacacctgtctcggggtgcgctgggtagacaggaggtgctcggaccctccaggccttggtgtggacagttgtgttgttgaccttgttggccctgggtggcttggaggtgtgctaagaacacaaagctgtgaattcaaggaggggtttcttcatgtcgttcagcgtcataagcgttcatttttatgctttaaaaaaataccttcaaaaaggaggaaatgaagtgcgatgagaataatttgtagtggattaccacctgcagaagtttatttcacataggatgctgtgtaattggtggctagccgctgcctgcgtgagcgggatagatgtcgttcctgctccctgcatctatggcgggggcgtggcttgtggcaggtgtactctctgtgctgtttacatttatttatcttagaaatcactctagtcaaattcatcgagttgaagatctctaaaaagactggaaacctctgcttcaatttctgaatcatacataccattcattccacaaatgtttactgtgcattattttgtgccaggccctgttctaagtgctgcaggttctggagtgaacaaaacgggcaaacatcaccagactcttggagctgatgttctgttatatccttgaagccctgaacactgctctacttattacatcaaaagctatcaattcaggttaaggggcactgtgagctgccccaggcaggtgaacaaggacattaaattgccatctggatgttaagagattcctgtcctctttctcaatgttttgatgtgcttgcatggtgaaatgaccatatttgtatgttgtggcttttatttaatttttttttttttaagagacagggtctcgttctgtcacccaggctggagtgcagtggcatggtcatagctcactgcagcctcaacctcctgtactcaagcgatcttcccacctcagcctcccaagtcgggattacaggcatgcagcaccacatccagctaattttttattttttgtagagacaagtatcttgccatgttgcccagggtgatctcagttcctgagctcaagcagtcctcttgtcttggcctcccaaagttctgagatttataggtacaagccacagagcctggctgacttttatttttccatttctacaatgccattaatgatcctgagcattaaagctgtggatcaaaatgttttgttttgtcttttaagcatggagatctttttttttttaagataagaaaattgtgaaccaagtctttcatccccatactgacactgacagagtcagtctgtcatgatcaaaacaaatcacattgactttagtcaggctttgaaacgcatttgaactttcttagtcacagaagcatcattcttcgtttacaaccacagatgcacacgtgtctaacgcagttttccatctgaacacggtgcacgcagtgggcatgatttctagggtttaaccgggtgcgggagtgcacagagccctgcgtgtgtattctctggaatcctcccaacagccctttgaggaaggcaccatcaggattgcaggctggtgccccaaggcagagagaagctgagtcacaacaggtgacttggaagtggggagaggggaggattcctcctagtggctccatagcccaaggaatgtgcagcccacaggttaggaccaccttattcaagtttacgcctgagatttcctgtctcggagaagaacaactcctcgggacgatcatcaaaatcattttgtgtcctgaagtgattcatcccctggaaggcattcaacctcggcctcctcctgacaacacacactttggagctctcagaacatcgccccatccagctgtgctacagcatgtcagattcagtgactgacctatggtggttccctgttggtccgatgtgacagccacctgcgctgcggcagtgacagaggctgcatcctggcttactcctcgctgctgtttccttccaggtttccgcagctagggctcgaaagcccattcggaagtgaccaagaaaggccaacagaattcctcatagcccctgcagcccgtgagaagaagacacagccacgcccccaccccccagtgggagcctgaggccacaggcgtgtttaggaagctgtccctgaagacgaaggagccgctcaggctcctgactcccctggccccagctccagttcccctgattgctcatgtccctccctctgtgggaaagaggcaggggccacgctcccctgaccaaccttgccctgtccgctggagattcccatgggccgctgatgcgggccgctgtggcctccccatccctgtcctgcacaggatatcacaccccagccacggggtgaactgctccttcccattcagggcctcctacccttacctgctgtcagccccagaaatggttttaaattaggaaactctagaggataatagaattcgatgaaaaggcccttaagctcttgaaaacgcagtgctgggttagaggcttttaaaaaccagtgctcggtcagaggcttttaaaaaccagtgctgggtcagaggcttttaaaaaccagtgctgggtcagaggcacagcttcactggaagtccagtctctacccccagcacaggcagctgtgcctcagagggggacctcctttgttctgattctgtgtaaaacgggcctattttcatttccatgccagctgagaggtgcccttggggaggtgtgaggtgactgttgaggggcctcatatcatcatgagagcagctataatttggaaactgaaaaaccccacagagttggcatgccgaaaatgcccggaaaatagtgggtgccctcgtgcctgtgctcttcactcatctccacttgaatttcagattatggatcaggtgtaaatacttggttaaaaactaagtgtttggctgggtgcagtggctcacgcctgtaatcccagcactttgggaggccaaggcgggtggatcacctggggtcaggagttcgggaccagcctgaccaacatagtgaaacccccgtctctactaaaaatacaaaaattagctgggcatggtggtgtgcacctgtaaccccagctattcaggaggctgaggcaggagaatcgcttgaacccaggaggcggaggttgcagtcagccaagatcgcatcactgaactccagcctgggtgacaagagtaaaactccatctcaaaaaaacaaacaaaaaaataagtgcagcttgccagtcacctctgcccagcacatatcgcacatgggagaataaatcagccacacagcagacggcagcatggggcagccatgccaaggagagggtcttttggctgttgtgcaagtgactgtgccacccacaggcctttggaattgagaaacaaatgttaagaaatgtgactcgcagcacaagatggagcaagttgccttatgaatccttctggatataaaaattgctgcagatcttattgtcagaaacgttgacatgggtagtgtcatcacgcctttgcagaggaagtgatgctcgagtgttttgatgtatttttccttaaataccgcttcctctgaagccttggaacggcgcgttacacagatctcatctgcctgctccatccacgccaactccttcctttccgactcatccttcctgaggccccgcagtcctgcacacggtggtgacggacttccatttgtgtccagtgtaaaagcaaatcccatcataacaacatgtctttgagagtttcaagcaaggaacatggattgtgaaatacacgactcggctttgagcaagtcctgtcttggggacagtcttttagaggagccacgtgtgcagtggtcctggagcggtgcctgcagctccacggagcaggttctgcacttttcctagagagagcatcatgttgccctgggagctgcactcaccccctaaccgtgccgtccacctcggcagcatcaggtgcagccgccaccagcactgctggcatgggaagggggtggaaatgggaggaactgccccatcaggccgctggggacagggagatcagttctgttcagggctccatctcctgcagccaaatatctgggtcctcagataggcgacgtctgtgccccaggtcttgttcccagagcccgcctggcggctgctagacataataaaatggagtagtcactggggtgagctcagaggcccaccggctgtgctccagtcctggctgggtgacttgggtgattgctgagcccctctgggcctggccaaggtgtctgtctgctcctcgcagtaaccacacgaggtgactgtcattattctcactcccagaggaggacagcgggctgtgttatcagccttgctctgaccatggtgttctgtagggaaggctcattttgtcccatagcctggagcggcctcagagccctttcctgtccctgaggatgtggggtttattcctgacacagccactgtggagctggacagtccaggcctggcttgcagcggccctttccctgcatctgcagctcccccgtgaggatggtgctccaccctggccctcctgtgtttgtttcttgcgcttcccttggaagcacagccctagattcatccctgcaggcgattccccagggatgtcagccacctccgtggctgctgcaagcaggagctctcagtctgccctcacaccccaccccagcagcctgcagggcaccaccctgctcgggaaggtcctggttctcagtcatgtttgccaagcgatgtggtgtaaatactcccactgctgctgagttcaggctgccaaggtgaagtcctccagctcacacaactgctggaaacttagcagtaggctcatgagccggctccagcacagcaccgggctccgaggaaatcctgtgccacccgccagtccttgtccttcctgtcctgtcctgtgtgctttgacacaggagattgctctctccaccaggaaatgcttttcttcactcaccagcagcctccctcctggctgcgcctttcaagtccccatgctggtccctcatctccccagctcttggtggtatagcgtgtccatgcactgtcctcccacctcggcaacctcgtggggctcggctgtatacaccgtcctgctcgtatacactaccccacccatgtataccatccccccgtgtataccatccccctcatgtacaccatcccgctgtgtacaccatcccgctgtgtacaccatccccctcatgtacaccatccccctcatgtacaccatcccccgtgtacaccatcccccccatgtacaccatcccccctatgtacaccatccccctcatgtacaccgtccccaccatgtacatcatccccccatgtacaccgtccccaccatgtacaccatccccccatgtacaccgtccccaccatgtacaccatccccccgtgtacatcatccccttgtatacaccaccccacccgtgtataccgtccccccatgtacaccatcccctcgtgtacaccattcccccgtgtacaccatcccgcccatgtacaccatctcacccatgtacaccatccccccgtatgccccatccccccgtgtacaccatccccccgtgtacaccatcccctcgtgtacaccatccgcctgtatgccccatccccccaccgtgtacaccatcccgcccgtgtacaccaccccacctgtatacaccaccccgcctgtataccccatctcgcccatgctcccaagtctcctccgtgagcgctaggcctactaagtagccacctgagtcaccagttccactgggcgcctgacagacatgtcagtggaagccaccccaaactcagcttctctctggaacttttgcagctgttcaggcaccaaacattggaaccacttttcatggttctgtctctgcccacatgcaaccaccagtgagttctggtaactccaccttcaggagaggctgagtccggcccttcccaggcccctggctggattattccagcagcctccttgccaggttcccgccttccaccctcctcaccgggttcccgccttccaccctcatcactgggttcctgccttccaccctcatcactgggttcttgccttccaccctcatcacttctcttcacacatcggcagaaggactccttagaaacactctacagtgctccgtctttgtttaaaaccctttgacaccttcccatagaccccagccaaagcccaagtcctccctgggtctgtaaagacctccgtgatctgcccccaccccatcccgctgacctcatttcccgcatccctgcctctccatggcctgctctagctacctggagctcctggctgtttctggagcacacagaagtgcccctggaattctcccagcatcccacatgactggctccttccccctgggtctgtgcttacatgctccctgctctgaccgtccctgaccacccgattgaaaatgtcatcctccaccccggcactgcctgcctgctgctccaggcacgccctcttccagagcaccctagaatccaggtgttgtggctctcccacttgactgtgatctccacatgagcaggcgttaggtgtctgttcactgctacatcctggtgtgtaacaggcacttggcaaacgtggagggaatgaagggctgttgccatgtgtgtgtgttggcgaggggggttacgtttaagcagccacctgtgtgagctcaccttcatcagtaggcagcgtgaccatccaggcaggtatgagatagccactctggcaaggacggccttcacagaagggactcgaggtggggactgaggggagggtcccataggccagctgcggaattaggacacctgcccccacagcttaccctggccagggtgttgaaggctgcaggtcatgatgtcttggtgcagaaggagaaaaggagacctgggctatgtgttctcttttgaaaagatagtaatcttatgttacatggttctcccaccttcttgaaacaaacacacaaacagctcatgttttttcaacaaggatgaattgagcaagttggaggtgggaggccatgggctggccctggggagccctggtgcccaggccctgcagttccagcgccatgcagcctctggtctcatgaagacgaccttggcctgttagctgccccccacccccgcagggacttggctgggagggcaggtgctaaaagtgtctgccgtgtggaggcaggaaggctgctcagaggatgggctttcccgctgaaagcagagggtgggctgctgtctgggatgagcccagcagtttggaagagtgtgagggagatgaacggtctcagggaggaagtccggttgctgttctggagctgagacagagcccagagccttctgtgtgaacagggagagagccaggacagagcccggacagagccctcccttctgctcggtgggcaggcattggcagacacccagggcttccttgtaggcatgcaggccgttggctgccagccctgccctctgcaggcagcacctctggctggtggcagagttcattcagcccctgggcacgtccccgggtgtgtctccgggccagatggggctgcacagttctgcattagcttaggaagttggttttcaagacattgatgcttccttttgtctgtaacagtcatttctattttaatagaaaataagatctgtgaattagaattttttcctggtcaattgcaccccattcgaacctttccttttcatttttcattatggcaattgtacattcacctagttctcagttcagatggagcacatactttttggagaatttctgtcaaatatgctagagtgttgattctgctgatgcctgctttcaatgtgagtgatgccaggagtaactgtttttctccccacctggctgtggtgctcccagtccttgaacactgcgctgaagcacctgtgcgagatcctcacggacgatccggagggcgggcccgctcgcatccccttcaagacgttttcctacgtttaccgctacttggccagattagactcagatgtgtctcccttggagacggaatcctaccttgcctctctaaaggaaaatatgtaagtatgcaccctctctaggattcaggtatgttgaccatgggagaatttcctgtttcacttcccccttgtagggaaaaactcagtttttcctttgctctctcaccacaacaataatcaacacagaagactgctatgatcaaatgtgtggaggtttttcctcaccaaaaagcaagcaagtggtcctgcagcagacaccagctgtgcattctcattccgtctctaccctgtctacctggagatagcctgagatcccacaggttgagggttcagtccccaagactgcccccaccctgccccatttctgatgctagttgcaagccccaggttattttgcctgtgcttctgaccgactggctctaaatcagggttcccacaacccctccttgggtcaattaatttgctagaatggttcacagaactcagggaaacactcatgtttactatttgattacaaaggatattttaaaggctaccaacagtcagaggaagacagacaaagggcaaggtctggaagggtctggagcatgggggcttttgcccccatggagttgaggtacatcccctccctgcccgcaaatgagctcttgttcaccttcctgttggtctcgatgtgtttagcttccgggaaactttctaagccctgtccttttagggtttctttttcctggaagctttgtgattgattaaatcattggccaatagtgatcacctaagccatcagcccctctccccacctccaaggttgggctgggctgaaagtcccacccctctaatcctgccttgggctctccagtgaccagccccatcctgaagctacctgggccatcagccaatcacaagcataaagaaagaactcactttggagattccacagattttacttgtatgccaggagcgggggttgaagaccaaatatatatttcacaatatcacatcccttgtctgcaataactttgtcccaacgaatcccgtgtttggcagaaggtttaggcacacctgatagtattcagggtgtgtgtaagtggagccgcagatcaaaggccatcagcgaaagcaagcagcacctcagaagggagcccgacctctcccgtggctcccacccatgtgggctgaggctcaggtttttttagactttagagggagagaatgtatcttgtcattaagactcatttatcccagatctatcctgattcctatgtacagcatgtcaggtggtactaaattgtagcatgttaaaaagtgagatagaggctgggcacggtgcctcacgcctgtaatcccagcactttgggagtccgaggcaggtggatcacttgagatcaggagttcgagaccagcctggccaatatggcaaaactccatctctactaaaaaaataaccaggtgtggtggtgggtgcctgtaatcccagctactcaggaggctgaggcaagagaatctcttgagccctgggggggcagaggttacagtgacccgagattgtgccattccacttcagcctgagcaacaagatcgagactccgtctcaaataataacaacaataataataataataataataataacttaaaaagtgagatagaattcatttctccacaatgaaacgtagacatggattactgctggtggacctcctgacagtagtgccacggatgcaggatcatttgcagaaacttgaggatgtcattgacatcagccacgcaattctcactctgatgaacttgctatatgaccccgacacattgcatgttatgttgtatttgcaccaggctgcatgtgatgtaaggctggttctgctctgaagcatgacttggagctaacgttggaatatattgtccagtgttctgatcacctgtaacatttttaaacaagattaatgaatcctccctttaaagacaagatgcagagtaaaaaggaacaaagctcttgggtcctgcggaagttctcatttgttcattccctaaaccatcattgggtgctgactctgcaccctgcactacctatggggaggcagagagagcagcccagggctggtggggtgggcagaggtggtggtgacaaccgcagggtccggggagctgtggtgctgcagagtaagcctggttaacagcaagaaagggccttctaggtgcaagggcaggaaagggcccaggtcctccaggctccagccccaagggagatggggtccctgaggtcttcccggcacttccccttgggaccactgccccccaagtgctggttatggtttgtccctgagccccacacctctcatctcgaattgcccacagtacagtttattgagcacctgctctgtgccaggcattggcgcaggtgccggggatgtagtcagtgaacaggtcacgccctgacccctggagttttgccctgtggagcagacagacatcagacaagcagattttaagacagtaggtcatgttcagtgccaagaggacagtaagccagggatagggaccaatgggggctggtcccagggccgccttctggcacagcacacacccctgctcgcctcagcctcctgagaagccccctggcctgtcatcaccacccagagtcttgtcccctcctcccaccctttccaaccggccatgatgccacctaggatgcaggccacagcaccaggagctggcgctcaagtgatccgccagcctccgcctcccttcctgtgccagtggagcctgcgttctgtgccctgccccacctgtcccagccgtcctcgtctccttgtcccttccacatcgtttcctctccttccttcaaactcacatcccctctgcccaccatgggctgagcctctggactccatggtccctctttttcctccttcctctgtcatccactgtcactccaaccctcctgtcctcgtggaagaccgcagctcccaagccatcccttctgtccgccttattcttgacaccatcctggctggtgtctgcagtcacatggacgacacagtactttgtccccagctctcctcctggtgcccacagcctctgcttctgcaccgccatccgggtcatgctgggccccttctcctgcccgatccgcgcacctcttctcttcttttgtgctctctgatgcggctactccgcctgacagagccacctgggacatgggtggttccatctcattccaaatccatgtcccaagcctccaaagaactgggaccctgtgcagcagccacttctcccaccactttcctgagatcacaagtcatcaaaaaagaaaaacctatgcatatagcacccatcttttcacctagaaataaagctacatttattatacgttttggtgcactttgcacaagaaaatagaatgctttatttttggaagtaagaattactgatgagcaaccataaatagtttttaaaagtagaccttttaaattatatcgcattttataaaaatgttactaagtatatgatgagaaattaccaataaatatctttatctgtttccaatttagagacgccaggaagaacggcatgataggtctttcagatttcttctttccaaagaggaaacttttagaaagcattgaaaactctgaagatgtaggccattaatacagagaagaatacattttaatgtcaaaatagtgctctttaaaattctggcaccaaatacaacttaccctgaatcacacacctctgtagtgtgagtgtttctctaaatgggaatttagtgtgactgcttcgtggggcctgattcatgattgcttttcactgtgtcttttagggaccttaagtgtaagaagttgataacagtaaaatgatctcttttaagaaaataatctatttggagactgcagagtcagaagtggggctgggcagtttgaaaagtggctttttgggccgggcgcgttggctcacgcctgtaatcccagtgctttgagaggccgaggcgggtggattacgaggtcgggagatcgagaccattctggctaacacggtgaaaccccgtctctactaaaaatacaaaaaaattagccaggcgtggtagcgggtgctgtagtcccagctacttgggaggctgaggcaggagaatggtgtgaacctgggaggcagagcttgcagtgagccgagatcgcgccactgcactccagcctgggcgacagagcgagactccgtctcaaaaaaaaacaaaaacaaaaacacaaacgaacaaacaaaaaaaggggctttttggtcaggcgcagtggctcacacctgtaatcccagcactttgggaggctaaggtgggaggatcacttgagtcagtagtttgagagcagcctggctaacatggtgaaaccccgtctctactagaaataataaaaaaattagccaggcgtggcggtgggcacctgtaatcccagctactcaggaggctgaggcaggagaatctcttgaatctgggaggcggaggttgtagtgagccgagatcgcgccactgcactagagcgagactccatctaaaaataaaaaaaaacaaagtggcttttcttcttcttgactccaagctggtggaggggctcgccctttgctccctgcctacccctcctaagactccctgggaagggcattggcagctgaggctgcatcttttctatgaaaggtggaccccagggaccctgctgcctggcctagcgtccgtggctgggggaaatgtactggacagcagcgtgatccacttgaatggaaataagcatccaagatcctttatttgctttccttttataaagttttcgaaaaggccaataccaatgaatacatttcaggttagcttccaggccagggctcaggccctggagaaaactcgtgcgaatgcctgtctggggggcccaaggagcgagtgtgggcccctctaaaacttagagggacagattacatgacgactttggggacagcttgctaagtgtccatttggcagcatctgggatgagacgtgctttcactgtgactatcttgttgggaggtgatggggaggggaaatgaagcccctgcctcctctaaccctggaggctgcccacgtttaccaagagaatctcacccaatgctgaccagctcagcgtgcaacacagcatcactgggctcaagaaaagacatttgaagacgagttttgtaagcccgagcataggtgaatatcaccgtaaataaactccaacgtgaaaatctgaatgtataaagcataaatcaggaacagcttttcactcaatcaaaaaggcatgtggtgtttcagtaataaaaagcatgaagtgtggagacgcgcggcagcatgggtgtgatgaggcccgtccctgctggtgaacaagtcctggcctttgtcccttgaaaaggcttttgtctcaaaaagtgggttttcttgggaatgacttggtcatagaaggagaaatagcattctgtatgaatcggtgagggctgccagaacgaagcaccggagacccagtgcttacgtagcagaaacacttcctcactgtttcggaagcagaagtccaaggtgaaggtgttggcagggctggtttctccggaggcctctctccgtggcttgtggttgctgtcctcctcctgggtcctcacatggtcttcccttgtgcctctccgtgtcctcgtttcctcttcttattagaacactggtaatattgttttagggcccatgctaatgacctcatgttaacctaattaccttttaaagatcctgtctccaaatacaatcacagtctgagttgctgggggttccgacttcaccttgtcaattttgttggtggggactcaagttcctccgcgccacattacttctcccagccctcagaatggttttagcctgacttggcaagtgagggctctgaagttcaaacagattttcccatagaaacatgcactggctctacaggtataaaaagaaatgtaaatagaaaaaaaaaaaaaccagaaacaaaacaaaacaaaacacaaactggccttgtctagttgacacaaaaccaaaaagtatgtgagacagatctcaatcaacttcgaagtttattttgccaaggttaaggacgtgcctggaagaacaaaaccacgggatcacagaggcagtctgtggtctgtgcctttctccaagggtgatttccagggcttcactgttgaaaggggagaagcggtctggaggcgggaggggaggatgtggtcattactgaatccacaggctgcaagggaaaagttgcagacagggaatcgtcagttatgtatcttatggtctcgtgctcagtaaatctgcgcttcacccaagataaggtgaacccagagctgctacctgaggagattttaactttttctctgtagctctgtgctgaggagcaaaaggaaaggcagcttcctgcatgactcagcttgcagcttcatttgttttccttctggcagagtgaactggggtcccaagtttcttttttcctttcatgacaccgtctgaacacctgtgtcgtctcagagtagtgaccaaaatgccaaggcctcattcggaggataagcactcatctgcccagccagacccaaggttttcagaacactccttagcgtggactctgggtctggagcagagtggaggtgggcacccaggtcccgtcccctgagtgctgggccactggccggctcagcatgagactcagacgcacagcccttagatcacccacacatcggagtctcctgcttaacgctctgtccctgtccctcccccagcacagttgggggtcttcgtctggttcctggtcactctcggctcagctccagcccccaggggttgtccctgcctcacggttgactgtcaccattggggctccaagtgcccagaggccgagctccatcatgggtggaagatgagctaattttgtaattaacaaaacataaagggggatcactctccatgccatttagtgggggagctttaaatatcttgctctaacacctgattaatgtgccatgcttctgtgagcaaaaagtggattgtttgtgcctcataaaccggattcctaatcccagaatactcaggcagagggcttcctctcatcaaggaaaacacgttccctattctgttgattttgactcttcttgttacaaggctgaatcatctatgttccccttcatagcctgcagttatttcttgttaaaatagccataggtagttgggctttcagtcagattgttgcttgtctttagggggtaactcaaatggtttatttaataactacaaactttattgcaaatatcattaactggtcaagatgttgaataaaataaactgttcaggtggctggtgtgtttgaagaaagtagctctgggaggagaacagcagaaactcccttgctgcaatgaacatgggaggaggtgcctgaggaccctaacgggattgataggggctccagtacaataatgggagatttgctatcacgtggagaggaggccacatctggatttagcacctcaagagtcaaagacaatttttccaattgaagtcactttaaaaataaactttgggctgggcgcaatggctcacgcctctaatcccagcactttgggaggccaaggtgggtggattacgaggtcaggagatcgagaccatcctggctaacacggtgaaaccccgtctctactaaaaatacaaaaaattagccgggcgtggtggcaggcgcctgtagtcccagctacttgggaggctgaggcaggagaatggcgtgaacctgggaggcggagcttgcaatgagccgagatcgtgccactgcactccagcctgggcgacagagcaactttctttaaaaaaataaaaattaaataaactctgaagatgatggagcgtttgctggcactgtggctcatgccttaatcctagcacttctggaggccaaggtgggaggattgtttgagcccaggagtttgagaccagccctagcaatggagtgagaccttttctctacaaaaaaattaaaaaaaaaaaaaaaaatcagctggaagtggtggcatacgcctgtggtcccagctacctgggaggccaaggtgggaggatagcttgagcccaggaagttgaggccacagtgagctatgattgcatcactgcactccagcctgggcgatagagtgagatcccgtctcaaaaaaagaaaaaaaagttcctggcattcatacggtgtgactttgaaaaacacctgcttttccttaattgcagtgtggggaggggggtggtgggaagcagaattgaaaaagctacaagatgcagatgagtggacagtggttttatcttatgacttaaagaatgctctgtcccattgaaatatgtgtcttaagtctttgtccaggcagcaacgagtggcttatttggtttcaagctaactttatttgttggcttctgtatttttcatctctaaagaaagtggagtatatttcttctgttggtttatgaggtataggaaaagaatgaaagcagggatgactccagaaatacgtgcttacccagcatggtggagttctgaggtggctgggcagggccaatgatttgcttttgaaatgattgtgctaagagtcacacattgaatttacgattagttgttatttcttggcaatcactaacatacttgtgaattctcattgtgtgagagaatctaacttacaaatcgttttcaaatgtagtgagatttttatgtatactaaatttagcaattaatgaggaatgaacacagaaattaatcatttattgagtctgattttgctatttccgtaatttgcagccaataatttttttcaagtcttaaacattctcagaggtcgatgaaacccttgtcagcctgcggctttgtgccttagcatctcaagaatgaaatgtgttcaggtcccccgtcctccaaggaaaatcccaactctattatgttgctttgtacaatttgtacaattgtacaatcccctggttattgaaggggatccccaccaggaccccatgaagtggacagaagtaggattaaccccctttagaggggactggcctagaactaagatgccaggggcagccaggtcctccttctgcccagggtccaggcccacccacctggcctcacactcctgtccctctcaactcttccatccaacagcattccccgtatctgtcccatttccccgttctggcttttggtaaggccagaagcccccacaggtgaaagaaactggataggtggggttgggttgatgtccactgtttcctggaaccttcatgctttccccgaggttggagcagggatcccacgctttcctgtgctgagttggagccagttggcctgggatatggaatggctttctgggcacatgtcccacctcaaaccccagtcccattcttgaatctcacgtaaagtattagcagggcgtgatcaggagagccacacagcatccatgaagtgccctggccgtggggcctcggggccggaaggacatttgggttgggataatattcgggcttaggtgaaaatgcatttacccagcacctgctaagggctggcccccctgccacgtacgggttttgcagctaattaagttctcatcccagtggcagggaaggctgctgtcattacccctgtgttatggaggcacacttccttgtccaaagtcccccgggtggaaaggcagggactgttactgggtcctggcagtccgactccagagccttggagcccaactccaaaggaaaggtgaagagtaaagtggctcttggggaggggacagtgatgagtgggagaatttgttccttgattctcttttcttttcttttttcttttttgagatgaagtctcactccattgcccaggctggagtgcagtagtgtgattttggttcacctcaacctctgtctcccaggttcaagagattctcctgcctcagcttcccgagtagctggtaccacaggcacaagccaccactgctggctaattttttgtactttttttttttttagtagacacggagtttcaccatgttggccaggctggtcacaaactcctgacctcaagtgatccgcctgccttggcctcccaaagtgctgggatgacaggcgtgagccaccatgtctgatccgtccttgattttcaattggggaagtgtgtaggtggggcggcctgttaggaatactggaacagggttttcgaagaaggtttcaaggagactgcttactaagatatggggagggctgaggggagcccacaagggagggtgcaggcccctgggctggctgcggtggggttttatgtcccgcagcctgaaagtgcaggagaagctgttgcggggatccacagagatggcagggctgaggagagggctcttggtgagagctgtggctttagtacaggggtagccaccccccacatccccccagggaggtgactgggggataaataccctccttccatttgtcttccatcctgggatcttccatcagggtcttgtcctggctgagcacaaccagaatctggagagaagaaagcctcatgatacacaggtcagctatgctgggctcagagcatggaagagccaggagaggctaaaggaatgtgctagacaaagaagtttgaaatatccagcacacggccattcgatgaagacatggtggggtccagcacacggccattcgaccatttgggtgaagatgcggtgggggagactcatacctccacatattcatatgcatgctcacagtgcatacgttgtttctggaatgatacacagaaaaaactggtagaaacctccaaggaggagaagttgggaggaaggctgcctgtgtctcattgtataacttttttctaccatttgattttcacttgtgcatttattatgtattaagtccacccatcaaccgtgcatttattatgtattaagtccacccatcaaccatgcatttattatgtattaagtccacccatcaaccaatcatgaaaaagaattggtgtctgagttctttgggcttggagtgtagccaacagggaatgcttgtgatctaggctgggcccatcacagtgctcccctcctggccaaagtgatttgcccaagagagttggcacatgacctgcacttgacggatgagagccttctctgggtttttcggcttggtgctgggagagagaggcccttttcttcttcctttgattaaaaagcttattaggatatgggtctagagttgtaggtgctagtagtcactaacatacgtgacactgttatgttgaaacatgttagctactgataatctcaaattttcatcccccaaacagcaatttcatctagctcaaccccatacgtgccaggcctcaaggagagtggattatacagggcgtgttcaccaggagggtggggatttgggggccatcttagaattcagcctgttttccacacgctaactcatttactcttcataaccatgttatcaagtggaaattattgttattaacctcatagccattatagataggtgaagagaaagagagattaattaagttcctagtccaacaccacacagtggtcctgcttgccctgctctcccagtctgctgtgagcccagcatggagcctgtctacactaacggggtgaggaggagaggaaggcagagtgccagggttcccaggggctaggatcatggttcttctcctctctaaggccagcaccacctcagctcagctctcaatttagttagacccagcaggcaagtccccctccaggcttacacaatatcagggtgaatacctggcctttgcaattgatttgacctgactttgaaatcagccttttccctggttgtagtcagttgaatagtgagtgactcccagaaagatatgtccatgtctcaactctggaacttacaaatgtggccttgtttggaaaaagggtctttgtagatgtcgttaatttaaggatcacaagatgtgagcatcctggatttagggtggaccctaaatccaataactggtgcccttaaaagagaaaggcagaggggagtttgagacaccaatgcaggggagaacaccatgtgaagacagagacagagattggaggaatgctgccatcactaaggagtgcttggagccaccagaagttggaggaagcaaggaaggattccctcctaaaagcttcagagggagcagggtcctgccgataccttgattttggacttacggtccccagaactgtgagacaagaaattgttgctgtttgaagccaccaagtttgtggtaatgtgtttcaacaaccctaggaaatgagcacacttattacctcttttcttgcaaaccaagtccaaaggggacaccagaaatgggacagagccctgaagcaagacctgggtttggttttcttttgattccgaaaataacagccctttaaggaatcaagaggttggggagaggttgaggctgaagaaagttgaagaactgaaagaatcttggctcatttggaggataagagagagttctagaatggagagaagatagacctgctctagaaaaattttctggctgggcgcaatggttcatgcctgtaatcccaacactttaggaggctgaggcaggtggatctcctgagtgcaggagttcgagaccaccctgggttacatggcaaatccccgtctctactaaaatacaaaaaattagctgggcgtggtggcgcacacctgtggtcccagctactcaggaggctgaggcacaaaaatcgcttgagccccggaggtggaggttgcaatgagctgagattgcaccactgcactccagcttgggctacagagtgagactgtgtctcaaaaaaaggaaaaaaaaaaaaaaaaggaaaattttctaatttccacaggttttcaatgagtttctgctgcagacagaatcctaaggtggctttcaagattccgtccactggcagacacgccccattgaatctccttccttgagtgtaggtaggtctgtgtatagtcaggtacacagcgggacagtacatggtgggacaattaccccctcgattgtggtctgtgacatgactcagcagtagcagactagagaggggttctcacactggctttgaagacataagctgtcactgcgagggcaccaggtgctgaggacatgaggatggcctctaggatttgacagtgacctccagccgactaccagccaaaaaacgagacctcagctctacactgccaggagctgaattctgccaatgacctggatgagttggaagcgaacctagagcctctgttgagattgcagcctcggcccacgccatgatgaggtttcttgccaggtgaacagaggactcagccaagctgggcttggacgctccacccatggagaaggtcagatgatgaatatggatcatgttgctaagtttacgatactttgttatagaacaatagaaaaggaatgcagtttctgaccaaagttcctcccaaattgtaactgaataggagcggctgagcttgagccttgattttgtgcttttttgctgatttggtggttttttatgaccaagtattaaaaatgggtgtatattttaaagtcatgttttgagacaaatcacacagttaaaaaaacaagtttaaaagtctctaaagaaaatagagaacagatgggcaaaagttgatcagtggttaaacataaatgtgttccagatgggaatggaaattgcttgcttattattgttggtgtggccagcagctcccttcagaagcctctcaggtggctttgtagcagaaaacctccagaaagacatctttccagggacgcctttccctggtgccatctagatggcagacttctagcaagttccgctagcagggcaccacagccacttctctgcagttctacaagccacagtcacaccctcttcaacaagacctggatctcagctcagggcaaggggatttctctgggtgtaccattccagtccttggggtaatggctgttattcatatctgctattcatatattctgtaaaattatctttacttcttgccagccagttcctcgtaccccgaccctattgtccttactgattatttatataaaactttccctgttcaaatcactctgtggtttctctctcctgattggacccagactgatgcactgttcccagcagcaagtagcactatgtgccaagcaccaggtgataatttcagagagctgaagtgacataggcctgtctccaaagagtaaacataatgcccacttcaacacttgagaaaagaagggagaagtataaaataaaatataaaaataaataaaaaataatgcccaagttaagcagacagagcatggggcaacagggtaagagactgggttccagacctgattctgcaactaagtatgggatttggggaggattgtcccatcgctctgtttcctcttctgtaaactacagaaagtaatggactcagaggctttctattagagtaaagctaagctgcagtaacaaagtaacaaatcacacagtggcttaaagcacgtagaagtttattttctctcaaataccagtcctcagatgaagggtccttggtgatggaactgctgtgctccacatgatcattcagggatccaggtcctgtccatcttgtcgctttgccatcatatggactttcaccctcatctgcatgggtgcagttcataggaaggtgaagagcagggaggaggccattgtcttaaggcccatacttaggagtggtgtctattacctcccctcacatgccggcaggcggtgcgcttagccacgtgaccacattgaattgcacagcaggctgcgaaatgcagtctctagctgagcagccacatgcccttgatcacatggaagaagtgagagcgtgttgagggggcaactttcaatgtccccaactcctgttccagctctgccagacccctctatgtgttgcggggcatgattgcgtgtaaactccagaccatttaggtaaagaaggaaaacatctctggcaaggtgggaaatacgtgcctcatcattctgcttttgcatttcagaatcaagatctgaagagcttgcaaaaaagttcttttagtgctgaaaagtaggaacgtggcagatgtgactaacaaaacagtccttgtgcatctgctagggagcacagattttctttttttctccaatataacaaattacaatccatctgggatttgagaagtctgagctaaggtttctggatctgtttgcatgtggaacaacgatgaaaagaagaaaatgataagtcagttttaaagaacttttcttgtgtttcaagtggaaagaaggcttgagaatttttttacattttactctggtgtagaaggacggtgatatttaaagagttagaatgagcattaaaacaaagacatgaaaataatcgaacccatcaattgtatttttatatgctggcactaagaccttaaaaataataatgtatctaattctcacaaaaatatgttaaaatgaggactatcatgtccattttaaagagacgaaatggaggcagataatttgtgtaaagtcaaacagctagtaagtcttggatctgggagttgaagttagatcatttggctcgagtctatcagagacctgcaacccttttctgtagtgcatcatatagtaaatcttttgggctttgcagacatgcagtctctgctgcaactgctcagctctgctgtgtagcatgagagcagccatagacaatatgaaaatgagtgagtgtggccgtgttccaataaaactttattaatgaacactaaaattaagttcatagaattccacatcacaaaatatttttctttttgaactttttcaactacttacaagtgtaaaaaccatttttaccttgtgggccattgtttgctgaccccgggtctatgcagttaaccttgacctttttcaacatgttaaagaggttaacccacatttaccgagggccactgacctgggcactgtgtggggcgctccatgtcctggtccacggacttgctagtccacagacttgctaccttcatctataggtagctcctgctaccgttattcacactgtatagatgaagaaagcaaagcggtcctactacaggtggaacaaggacacgcagccagccaggaactgagctgacatctgttgatggacaggaaggaaggatttgggtcagccatcaagactctctcaggacctgaggaaaagggcgggaaacttaggagcaagatgacaggagggcagatgctccgtgaggatggcaggaagaggacatgtatgcttaatattctggaaaatcctctgggataaggccaggcacagtggctcatgtctgtaattccagcactttgggaggccaaggcaatcggatcatttgaggtcaggagttcaagaccagcctgggcaacatggtgaaatctcatctctactaaaaatacaaaaattagctgggtatggtggcgttcacctataatcccagctacttgggaggctgagacaggagaatcacttgagcccgggaggcagaggttgcagtgagcaaagatcacactactgcactccagccttggtgacagagtgagattctgtctaaaaaaagaaaaaaaactattcaaaatcctccaggataaaactctctgttgaaggaagctttaatcagcagcgagcacatcaggcacactcgttgctgccccttctcatcccgcattccctctgctttggtcaggtggtgccctccttccatgggtagagccagagatggtgggttctggctggtcagatgggagtggacagagacccggggtcctcccggcttcatgactgcacgtggtgggccctgcactgtgtgtctactgggatggatcaaggtgcaaccagagaaaccttgagccctctccagatacttgagtggtagctgagttcctgcagcctctgtgagctcccttctgagcctctggctcccagtttcccagtaccctttctgtattagcttcctggggctgccccgacaaagtatcacaaactcaggggcttccgcaacagagatttattctctcacagtcctggaggctagaaatttttggacttctagcttcccggacttgattggcagggccacacttccttctaaggctctggctgggggtgggggtccttcctgcttctgccagcttctggtgatgctgacaatccctggcattccttggcgtgtgggtgcattactccaatctctgcctccctcttcacatggtcttctctgtgcgtacgactgtgcatcctctcctctcgtaaagggcagcagtcgttggatttagagctcaccctactgtggtatgatctcatcttaatgacatctgcaacagccctgtttccaaatagggccacattctgaggttctgggtggacatgaattttggggtgggaaacactcttcaagccagtaaatcttcctccccaaatcttgctaggtttccaatgcctaaaagaagtgctaattggagaaaataagaatagttttctacttatctcaggagcgggaaaagatggcaaaatggcatggccaattttggaaagaatatatagggtgttgtaaagatatgtgatgatgatgaggatgatgttttcaccaatatttgcagcctcttgtccacacagaaggattaggaagattaatgccttcgaaatcagctatattttagcactctgtttttagtgttttcatgattatcctggtgtccttgtttttgaggtggctgctataattatggtaacgtgtgtgagtaggttagaaagatgttacaagtgattaagctataaattagtcactttggagtgtgtaatagttctttcaagtccccagcatataagggaaagtgacactggtctacaatgactgtctccatgcttccatgcagaaattgagacctggagaatgtaaagacttgcccaagttctgtgagtgagtcagtgctagaaaaatcttgagcccagccccccagatgtgatgactattctctttcaaatatttctacaggattagaatgggcgctcaggcttggctcagacaccccacatctttaggtgagtggcttttaaattgccatttggtcacgcctacttggcagagttgcaaacacgggctgcagagttcacacccgcaccctcctctctggaagtggagtgagaacagggtgggcagaggtggggctgccacacctgcttccctggaaacccgagggagagcacaggacgccaggctgggactcggctggcagctgcttcgggcgtctcaccttgtgactatttcctgggcactgtgggagaggaggcctcttgcctgagctcctgtccctactgtctcctctcactaaatgcacggcacggctttgcggtaataggctgggacatgtcaactcttttttttttctgagacggagtttctcttgttgtccaggctggagtgcaatggcacgatctcggctcacgcaacctctgcctcctgaattcaagcaattttcctgcctcagcctcccaagtagctgagattacaggcatgcgccaccacgcctggctaattttgtctttttagcagagacggggtttctccatgttggtcaggatggtcttgaacccccaacctcaggtgatccgcctgcctcgacctcccaaagtgctgggattacaggcatgagccactgtgcccagccaacatgtcaactctttaggagagtttgaagacaaaaaataacccatgtctgagcatgggaggtgctaaaaataggaacttcttagcttccacaagggcagataaatgaataaataggccataaaccaatgtagttatttcagctgggggattttattttcttttgattgtcccctggagctacgaaatacacaaatatagactgatagatttttttcattaattcgaaaagcatttaatggctgtcatctatgtgccaggcaattgatgcgcagccagacttccaggaggctggagggggatccagatgaacctcccggagtaggattgtcaggaggggactggagaccagggccatcctgaaaaccccatctctgttccaggaaattcctaggatcccctgggaggcacagcctggagaatcctattttggttgctgaacagatgcacacattggaattgagactgcgtgtgcttggggtgggtcggtgaggcgggggcagtggggtccaggtgggagccgtatggaagccctcccctccccatcctccaggcatgccagcgagtgtggccttatgttgagtgtgtcctccagtgtgagtggctcctccgagtgtggtccaaggacccgcagcatcagcatcccctgggagagccttggaaatgcagaatcttgggatccagctcagacccagtcagaatcagatttccaggcagctcgtgtgctcattgatgtctgagaggatctgcttgagaactccacagctggggctgacaaatccccctctgacctcaaatttacctcctccttctaaaaaagccagacaacctagctccctgcccacccacagctctttccagtggatccaacttcctctcacacccagtttgagcagggggagacaggaagggcctcttctctgcttccagatcgtctgtttcttccgtcaaacaccacagttcctatgaaacccaccgcagtagcagacctgggtcttgtcaagagctatgaagggtctgagattttacctactcctaggctaaaagttagcctgccagtttgacaaatgctgcctaatgacacgagactcccggggcagagacaaaggactttgctactcacagcacagcaagcagcataagttttgctttaaaatgtggtgtattaatgcaatatttgagttatagtaaggccaacagatcaggaaatgattgtcattgaaaggacagtttgttactcccagttcccaggaggaggggccacgctgagctatgcagggccacgagcgttgttagcaggctcaggagacagcggacatgtgggcaaaagccttgtttgtgtccctagttgtccggtacttgctcccagggtgattaggcaggtggatagtggcctggagtgtgaaaacccaatagaggaggtgtctggggcatgggcttgcaactggttggtttgcatttgaaaagcatgtttgcaggagcctggtttactatctctggggattggttagtactgggtggggcagtccctccagggtcagcaaggtcccagatatcaaagcatcagaatgcagagaatggaagacatggttaatacaagcttaatgtttgcactggttccctatgtccccaaaaccccatgggggtgacgtggggggcccaggtggatgctgccgcgcagtgaatttgcatcagcgagggaaaaccctgagctcaggggatgcagatgctttataatgggcagtaagcaaacacacctaacctttgtcccagcgggagatgttatctttataatattaggtaataaccaaacctgctctctgctctgtagggagacaccacctctttgcttctccaaggctgtttgctgcatctgaaaagacaatctggaacaagaggagagtcaggccagccacagtggttcatgcctataatcccagcactttgggaggccgaggcaggtgaatcacttgaggtcaggagttcgagaccagcctggccaacatggggaaaccctgtctctactaaaaatacaaaaatcagccgggtgtgatggttgcacctgtaatcccagctactcgggaggctgaggcaggagaatcgcttaaacccaggaggtggagattgcagtgagccaagatcatgccactgcactccagcctggtgacagacgagactccgtcaaaaaaaaaaaaaaaaggttaaaatgctacactttcttatcatagtttaccgcaattaaaaatcaaaacaaaacaaaacgaaaaccgtaaaagataaaccttttcgaatgctactatttcctgtatcataaacagttcctcttaggaaggcctttctggtatattaaagacctgctccagaaaacacaaagcggatcagaaaaacaaaaagtggatgtcactcatggacattttgataacatcaatgtcatgtacatttctttcccataaattctggggaatttttaagtggcatgtggggctctgaaaggttaggagagatcaggttttaggggagtggggaactctgatgtaatggtctaatggcccaacaaacttgggtgccagggctctggcatgagggcagagaaagggctcttggaactggggtcctggtgggaaggggagggatggacacggtagtgggtagaataatttcccctcaaatttcaggtcaactcggaatctgtcaatgtgaccttactcgaaagttctgtctttgcagttgcaatcagtgaagaatcatgagataaaataatcttggatttaaggtgggccctgaatccaatgactcttgtccttatatgaagagaaggatgacaacacggagtcactctgaaagctcagcgtggtagaacttagcagcatgatccagctgtgaggaagcagcttccaggtgtgctgccagctgctgacctagggggttcaccaagagggcccctccctgcccagtgccctgactctggggtccagggctgcacacttggatgacagaaggacatgcccaagcttacctggctgctcagagaatataaccagacagtcagcactgactactcacatgctcatgtttattaagagactctgactggtgggaatggagtcatcagagccaaaagcacgtgtgcaaaagaaaatgagcgttttcaccttttaagcgaagattgtttgggggttgagagaatgctggagcctgcgctaactccctgggccagcacaactgcgacgtgtcctctgcaggggtctccagcctggtgctcccagcgagataaaccagggattacgtctagagggtcagagcatctgcacctgtctagacagaggctctaaactggggcagtggggtgaggttggaaagcagcagatgggatagatacacggagttggagggagtcttctatttaggggtatctcagcagacattctcagctgccaaacagccagccccaggcatttccctgttgcagaggtgggtgcccgtgctatccaatgattccctcggctgacagacagggatggggtgaagaaatagcaggagaagatgagaaggaaagggtgagtgaaacagaggaggtgggggaggaaagaaaatgtaaatgacacacaaaatgctctgagatgcttactggatgccagacactgtcctgaatgtttcgcgggcactgagtcctcctgacaagcccatgagggagagcttttatttcctccattttccagaggtggaggctgaggcagggaggtgggttatggcctttctgcgagcattcgcaaacattcaccgaaacacagtatgttcaccaacatagagttcaaaagccacactgagaatctgcgtggtccatcaataacgtgttgggcatgttctatgatctgaaatccactaggaccctgggctaccaggcccaatgtctctctggagtgtctacagcctagccaggggaaagagagatgctaactataacaatgacatgggataatgttgttgtccaggtgcagacactcaagtattgggaggaaacaaaaggactggaaattgagcccaggcgtttgagaccagcttgggcaacattagtgagaccccccccaacccaccgctctctacaaaaattaaaaaattagctgagcgtggtgctgcatgcctgtagtcccagctacttgggaggccgaggtgagcagaccgcttgagcccaggagtttaagaccagcctgggcaacatggcgaaaccttgtctctacaaaaaatacaaaacattagccaggcatggtagtgcatgcctgtagtcctagtgactcaggaggctgaggtgggatgatcgcctgagcctaggagaacaaggctgcagtgagccgtgattgcaccactgcactccagcctggacgacagagtgagaccctgtctcaaaaacgaacaaccaccaaagaactggaagagtcctgcaggcacttgggattgctcagcaagcacccgggagagcttcacaggggtctggaatagtccagcaggtgcatgaaagaaccccggctatatctgtaccttggaagagtcaagtgcaggagctaaatttccatgggaagaggtgagggacatggagttagattggaaaggtctctgaatggcaataaggagaatgatatcctgtgacccaacatggctgctatccgaagatttccaaagtggaaatgtgttaggactttttccgttgcaaaagatagaaatcaaattcaaacaactagactgaaaagggaatgtgttaggactctggggagctctaagaaccgtagtgactgcagggacatcaggaagaataacgtggcttgcgaatggagccgagacaccctgtggctccccctttgatctaggtttctctgtgcctggtgtcattcctcccctgcaggtgggcattctccatgtggcaggcaacctctgtgtggcagaaaaattctacagggcagggtaccgggaggcaggtacttccatagggcaggctgccatgagccagcacctccagatagcagtacttctctgacatcattgcaggttagagatccctgaaaaacaatttctcagccttgattttaaaaaccccaaggaaggagggattctgattggtctagtttcagtcacgtgtcaacagcagaccaatcaactgtggccaggggcacagatgctttacagaggcaggcctgtgtcgtgtgaccaccacatgacctgcgtcatgtgatgggtggaggagagggtgggcatgctgtgattggcagcctccttcccgtgggtggagaccttttataaagggaagggaagagcgccatgtggataaacagatgttcaccgcaggaagggcccgaatcagatgggttttagagattactgggaaggcagccccagggatggtgggtctgaagctccgtgatcagccgcagaaatatttctcaactttgctcaacacaagcgcacttaccccacccctagataagaaaaacaagccaagcctttttagaatgttatctgaaattcaaaatagattaagtctcaggaagataaataaaccaaatgagcactgcttggcttctaaaccacacgcccatcccctggggaggcaggcagcccacactcctgccagaagagaaaagaccagctcttgaatggaatgaacagttgcattggtgggaggggaacaggcactggagttgattctccacgtgcttctcgctgtcatgggcccaggactgccgggcatctggtaaacatgcagattctgatgcagaagggccaaggctgggcctgagggtctgcttttccaacaagcttccaggtcgcggggtggggggggggggttgctgctggccctggcaccccactttgaaggagtgaagacttacggcctagcacctgcagatttgaatgagatattggcgaagagctgcgagctagccctcaaggaagccacccaggtggccagcgctggtggttccatctcagatggagctgggcatgactgggccaggcagatgtgtgggccttggccaagcctgggccggcccctgctctgggctgctcacacccatccctggccacacggaaaacttgtgtcagagccagcagggaaaggagtgaacttgctctcacttcacacttggatcagagcccgaggacctcagtggcggcccccttggggtacctgtgggggctgaaagagacagagcaggcttcctccaggccccccgggcagctttacccggcaacaagaatgggtgtcctaagccaacccctctctgtaggtagaataatggcctccaaacataacaggttttaatctctggaaactgtaattgttactttacgcggcaaacactttgcaggtgtgattaaattaaggcacttgagatgaggggattattctggtgaagagggacgcagggggacatttgacacagaagaggggaagcgatatcaccatggaggcagaggttacaggggtgctgccctgagtcgtggaagctggaagaggaaggaacagattcttcccagagcctccgatgggagggcggccgtccagcaccttgatgtcactgcctctggcttctaggactgtgtggaatagacttctgctgtgttcagcctccctgtgtgtggcagtttgttcccgcagccacgggaagtgcatgcaccacccccccgccgggtgctggggagacgtggaggtcttggggggcgtcccagggggctctgcttctctgctgtctcttcagaggagggcttctcttcgggctgttgggaaggggctttggggtgtctgcatctgttgaaatgggggctccgcgtggggcagcagagccccaaggtcgggagggtgttcaaggctgagcgcagcagctgcacaggaaagaacgcaggaggttgagcctgcgcctcccggagggagggccaaggaggagcagggaggtctgtgcccaaggatccgccaagccgcagcaggctgtccccactcactcctctctaaccaccctcatgccctggcctaggacctgacctcctccatggctgtggcccagcccactgctgccccagtgattcccgcatagtcagctgcgggcaggactaggggcctccctcccctccagggtcttccctgggacaccagcctgctccttgcagagtgaatgaaaggccttgttaactcaggccttctgcatcctaccgccaggagcgtgctcagtgcgcactggggagagacgaggggaagggaaaaaagcacaataggccgggcgaggtagctcatgccggtaatcccagcattttgggaggctgaggcgggcggatcccttgaggttgggagttcgagaccagcctggccaacatggtgaaaccccgtctctactaaaaatacaaaaattagctgggcgtggtggtgggcacctgtaatcccagctactcaggaggctgaggcaggagaatcgcttgaaccagggaggcggaggttgcagtgagctgagatggtgccactgcactccagcctgggcaacaagagcaagactctatctcaaacaaacaaacaaacaaaaaaaccaaagaaacaaacaaaaaacccaaaaaaaacacaacaaaaaagcacagtaattatattttaaaatcttctgggatacaacagattagatttccaagaaagggtttgtttgaatgactcattgtgcagataaaaatagttcttcagggtggggtgtggtggctcaagcctgtaatctcagcactttggaagggctacgtgggtggatcaccagaggtcaggagttcaagaccagcctggccaacatggtgaaaccccgtctctactaaaaacacaaaaattagctgggtgtggtggcgggcacttgtagtcccagctacttgggaggctgaggcaggataatcacttgaacccgggaagcagaggttacagttagcccagatcacaccattgcactccagcctgggcagcagagtgagactctgtctcaaaaaacaaaacaaaacaaaacaaaacaaaaaccctcaggtggagtgaatgagcctaattaatattccagaaacaattttgacaaaggtggcattacagattgaactttgtgtctccccagaaaaatacgttgaggtcccaacccccagtatctcaggcagtggccttatttggaaacaggtgttgcagatgtaaatagttaagatgaggtcctaccagacgacagtgggcccctaatccatgatgactgctgtccttacaggaagacagccaggtgacgatagagacacaggaagaatgccgcataacagcaacagaaacggagattagggggatgcagctggaagcccagggatgatgaggattgccagcaacccacagaggcgaggatgaggcaaggaggaatttgccctacaggtttcagaggggacaagccctatgcacaccttgatcttgaacttctggtctccagaactgtgagacagtaagtttccattgtttaagccccgatctgtcatactttgttagtgcagcccaagcaaactgataggggcgatgtctgccccttctttgctctgccctctgccacctgccatggcagccccccatggccccttctcaggtggtgacccccttctccttggtggcaccctcaataatcccctatcctgtgtctgaaaatgggcaatcacctttattaaagaaatgaggcttttctcactccccggccatcttagcggctgctcttggttggggtccgtcctgcagctaaggcgggaatttggtggctgcaaagaagaagaaaaagctcctggagtcgatcaactgtaggttccaactcattatgaaaagtggaaagtatgagctggggtacaagcagactctgaagatgattagacaaggcaaagcaaaattgatcattctcactaacaaccacccagctatggaatgttggccaaaactggtgtccatcactacggtggcaataatattgaactgggcacagcatgcggaaaatattacagagtgggcacaccggctatcattgatctaggtgattctgacatcattagaagcatgccagaacagattggtgaaaagcaaaccatgcaaaattttcctttaataaaatttgcctgagcttgttaagaaaaagaaagagagagagacagagagagagagaaagaaagaagaaagaaagaaagaaaagaaggaaagaaagaaagaaagacgagggagggaggggaaggaaggaaggaggtgggagttggatgcaaggaatgcgaccctcagggacccgcttcgaacagcccatcagacccacttttgcccttcaaaggaggttgagaagctccactctgttgtccatgcagctattcctgctcaagctgcagctgggacttttataagaaactgccttttagagccgggtgacatcccacatgaagaaaccagggccggtgcagtggcccatgcctgtaatcccagcactttgggaggccgaggtgggaggatcacttgaatctaggagtttgagaccagcctgggcggcatagtgagacctcgtctctacaaaaaataaataataaaaaaattagctgggcatggtggcacatgcctatagtcccagttacttgggaaactgaggtgggaggatggcttgagcctgggacgtggaggctgcagtgagccatgatcatgccactgcactccaggggggtgacagagcgagaccactgtctcaaaataaataaacaaggagtgccacttattgtcacatttggatttgtttctaacatcgtgctgagtttggtcacccacctcaatcacctgatgtgacttgaaaccacttctggctatttccaaaaatcagctccgcactgggaggggttagggctgccctttaaggaaacattaaaagctcagtatcttcctttggtggctccttcaggggcgctagcttctgactcatcagcatcattttagctctctgagggttcagaaatagaggaaacagcacttccttttggtgaacgcctttgtattattttattttttcaccatgatactgaaactagctcatcctgggagagtcaaaggaagctcatatgttttccctgagctgggctaaattcctgattcttctaataggaaagatccaaaacttcccacggagtttcccctcgtctgcactgagtcacatacctgtgggcttcgagctaacagaccttttttaatcaaagagaagatgaaaaaggcaccttgcttctgtcccatttttagatcttttttagccccatttcttctctttccttcctccatttttgggtttgtttggtttcacgcctgaattaaatgttaacaggaggagcaagttttatacattgcctgaagtcatcattgtcagagaaacaaatgcaatctttagtgaggctagcaatggtgggaagaagacgcgtgggttacagcaagcacagttactaaagctttttgcattgagtagctgtggggtccagggctccatctctctggccctcacttgctcatgagcaaatagaggcttcaggttgtagcaggttgtctcaaactagggacgtatattcaacaaacctgcaccttattcaaatgtagattctgatccttaggttctgggtggggcctgagatcctgcacctctaacaagctcccagatgacaagcatccaagatcacacttttcctagctctggatcacacttttcctagctcctagcagaatctcaggctcatcccagcctcttgagccagaattcaaattttcacaagagccccgattcgttcagatgtgcattaaagtgtgagaagcccacactggatcactgagggaggtcgcagttgcacctggggaaccaggaaccgtggaggcatgagcccatcctggagaccctgatttagttggtggggagtggcctggacatcgattgctgcctattcacagtggttcttgattttgctgccattaacatcacctggggagctctgaaaggcgtccccgtgatgttaataggcagcaagatcgggaactactaggctgcgggttcctcaggttctaatctatgatgtcattggctttatcagggcaatttttcctggccacattaggcaggagaggtgcctgtgcatctcagaagtgtctatggaactctgcttctgaacttcccagcacgctcaaaacaggacctggtttacagcaaagggccagctcctggcaacatcatgaaacaaacgtacactatcctctacccagggttcccttcagcctataggtgcccgacggcccctgctctgtgctccatcctgacatcaggaaacccacgaatgggagaaaatctcatgtcacctgtttacaggtgagtgaacatttaagtcaatgggttgctctctcctggggagctctaattgtagaatttaagagggcagagtgaagccagtgggagtcctgccaggtttgagtcacagcttggccacttatgagtccctctcattaccccaccagagcccggcgtcctgatgcataacacccaccacccggcttagggagggctgacagagtgaattactgacagaggatggcccttggccatttctgcttccttcactttcccatcactgccttagaatctggagagactcatgctggcttcacctggacaggcatcctgacacgcaagcgaggattgctcccaccaattttctgcgagagaaacaggggttcggttgattcctggcaacacgttcgtgtggggatgcacgtgggggtgcagagctggacttgggagatgcttcagctgatagcacacttttcctttggggagttttcttcctgctgttataacacctgtctccaaacaaagccttcattggtcaacagtgaatgattcatttattctgtgcatagacctatggcgtgagatgcatttggaaaccttgagaacagcggttcccaaccttggtgcttggagtaatgtccgaggacatttttggttgtcacaactggggcagggaactgttgctggcgtctagtgggtggggtccaggggtactgctaaacgtcctgcagggcagaggctagtgccaccgcagagaatgatccagtgcaaatgtcgctggtgctgagaatcctacttcagacccagggcaagactgattgcatgtgttcatttatatctgctcttgtagtcattcagtcaagaaatgagcaccttgaatgactattaaatcaagacaggttgggtgtggtggctcacacctgcaatcccagcactttgggaggccgaggcaggtggatcacttgaggttaggagtttgagaccaccctggccaacatggcgaaaccctgtctctactaaaaatacaaaaattagcagggcatggtggtgcatgcttgtgatcccagctaattggaaggctggcgcacgataatcacttgaacctgggaggaagaggttgcaatgagcagagattgcaccgctgtactccagggtgacagagcaagactgtctaaaaaaaatcaagacagatctctgagactccacaggtcaatggaagatgaacagaggggcggtggggctgccccccacccatgtgggaggcatgggcaatgcctaggttgaccagctgcccatgctctgaggcagtagtctcagggcagggtgtgcaccctcccaggcagggcagcactcacttatggtacagaaggaatcttagagcttcccttactcaggaatgaaatgagctctagcccctgccatcaccttttgctcaacactcacccactccaggcttcaaaaggaggctgcccacatggacagctcagagggactccagggcacgtggttgatggagaagccagatgcagagtggttcacttgggggtgcagttcaggaagccacggggtgggtgtgagggtgtagtggagcgtatcagtgcaaggataccctgagactgggggtgacattgactccacaggcacgggaaggagcttggaaacagactgaactcagaacatgcatgtcacgaggggaggggctggaggcttggggttgggagaggctgcctccactgctgagggcacaacttcctggttcagccccggcaggcctgcagatccccctgcatcctttccctgaagatgggccatctgtgcctagacaggttggcatgtgtattagattcttagggctgccacagcaaagaaccacagactggggggcttaaataacacaagtgtattttctcacagtctaggaggctggaattgcaaggagctcagggtgtcagcagggctggtttctcctgaggcccctctccttggcttgcaggtggccgccttcccatggtgtcctcacatggcctctcctctgatgtgccttcctcttcttagaaggataccagtcctattggattagggtctgccctaaataactcattaggacataattacctctttaaagatcttaactccaaatatagttttattccggggttctgggggttagagcttcaacatgttgattttgggggacacacttcatcccataacagtgtgggctgccattctccactggccctctatcctggagacacacctcctagagagtttcctacaacatgcaggacatctagttaaatttgattaaattgtatttcaaatgctgcatgggatacacttacccaaaaaattatcattgatctgaaatttacatttaacccagcattctatatttctagctgctgagtctggcacctctacccactgggaaacctcctactcatggctccttacctgggctgccttggtctgggacggacacagaaaggtggagggtggaattggtgtctggaggagcagctggtatctgggaatccatcaagggccctggcctcatggctctttcaggacaacctatagaagccactgagatgctggggtggcctgtggtttgatagaaaccgcagcatctatttaggtgaatcctggaggtacttcctgtttctcttccagttttcacatctctgtagaatgggaaatgtcacacaataacgaaccactaacaaatgatccaatttccagttgcagaaaacacatgacgtcatgcacatcatggtgttgaaaatatgggtgcccaatcccttacccacaattctgaaatccaaaacactctgggaacattttttatgtgtaaatttgaagacaaaacccatttggggataaaattgatttgaatggacttgggactatttatagactttctttatccattggtgagaatagtgatactgtgttttctggggggcactgtccagacatgtggggggttgtaggagattggtcagggtggtgggaaaaattgtagaaagaatgcaaaccttcctggaaggccaggaggttttacaaaagctttggaaaaggatttgggctgaaggcagccagattctcttatctggtacctgaaagcttaggttagataacaaggggatgtaaagaaactgatctagataagttagtttacttaggcctcggaacctggcctttaatcgcctgtgtgcaggactgctctctctgggggagtgaccatgtaaattacccacaagtgtgttgactcaaggcctttgtcattaaatctgtactaaataaatgcccgcagtgccagcttgtcagggccgtggctgctgactctttacagcaccctcctcagtgtctgtgagcggcctggtcccctagcccactctttcactggatacctgtgtctgagtgcatgtgttcatctgttgttcggccaggatctgcaggccagacccagcagtgggtagtaagtgatattcaggatatgtcctgtattaccagcctacagctccccaaactcgaatgccaaaaacccacagctttctggataaatgattgtgcagctacaacagcagacaggcaccgagctcttaaactgtgggaggcacaatgctaaatgctttaggtttcttatctctttaatcctcataatctgcaaaatggatacttttatttgcatttttggtaagctgtttttgtgttgaagtatgacatgcccacagaaaagcccacgaatcaggtgcccagctggaagaattattagaaagtgagtccacacccatgacaccacccagcgccatctctcagcagcgccccagaggctcccaccacagcctgccgccatcattacctcccagattctcactttcatcaccaaagattcattctgcctagaaaaaaaaaatgctgtcatttattgagcagttattatgtgccaggaacttatattatttctcacattgactctatcagggtgagtattctattttttttttttttttgagatggagttttgtttttgtcacccaggctggagtacactggcgtgatctcggctcactgcaacttccgcctcccgggttcaagcgattctcctgcctcagcctcccgagtagctgggactacaggcacatgacaccacacctgatgaatttttttttttttttgagacagagtctcactcttcactctgtcacccaggctgcagtgcagtggtgcgatcttggctcactgcaacctctgcctcctgggttcaagtgattttcctgcctcagcctcccaagtagctgggactacaggctcgtgccatcatgcccagctaatgttttgtatttttttttttttttttagtagagacagggtttcaccacattggctaggctggtctcaaactcctgacctcaggtggtccacccgcctcagtctcccaaagtgctgagattacaggtgtgagccaccatgcccggccagggtgagtattcttattatttcattttacaagcaaaaagaagccagagctgagagctgttatgtcatgttctattctatatcatattatgcatcttatcatgttatgtatcataacctcagctcagggaattttcgcagacagaacacactctgctaactagcacccagatcaaggaacagaatattagaagcagcagagaaactgccccctcaatcccacagccccccaagtcgctatcccctcccaaaggtaagcactattctgactcctgacaccttttgcctgtttttgaactgcctgtcaatggaacgaaatggtctattctttttggtgcctgattttctctcagcatgatgttcattaagcccatccacattgccacgtgaggctggagtttgctcttttttagtgctgagtagaattccaccattatttaagcacacctctatttattcacccattttccccttgcaggatggaggttagaaatgttttcactttttagcaatcaccagcagtgctgctctctaaattcttgcatgtcttttggcggacaaacacacacgtttctgtttagcatatgtgttggggcggattggggggcatcacaatagtgtgtgtgtgtgtctgtttagcttttcaaaaacttccaagctggccaggcatggtggctcacccctgtaatcccaacactttgggaggccgaggcaggcagatcacttgaggccgggactttaagacgagcctggacaacatggtgaaactccatctctaacaaaaatacaaaaaaaaaatccgccaggtatggtggtgcatgcctctaatcccagctactcaggaggctgaggaatgagaatcacttgaacctgggaggaggaggttgcagttagtggagatcatgccactgcactctagcctgggtggcagagcgagactccatctcaaaacaaacaaacaaacaaacaggccatgtgaagatgaaagcaaagatcagggtgctgcctctacaaaccaaggaaccccaggttttccctgccaacaccagaagttagaggagaggcctggcagatttgctctcacagcctcagtaggaaccaaccctgcggacaccttgctcttggactaacagcctgcagagctccgaggtgaggcacttctgtggtttaagcccctctgctcatgacactttgttactgcagctccagcatactcctccacggagtgatgcttcatgtttaaaaagacatctgctctgtaaagaacactcatctggccgggcgcagtggctcacacctgtaatcccagcactttgggaggctgagacaggcggattacctgaggtcagaagtttgagactagcctggccaacatggtgaaaccccatctctactaaaaataaaattaaaaaattagcagggcatagtggcaggcacctgtaatcccagctactcgggaggctgaggcgtgagaatcacttgaacccaggaggtgaggttgcagtgagctgagattgcaccactgcactccagcctgggagacagagtgagactctgtctcaaaacaaaacaaaacaaaacaaaacaaaacaaaacaaaacaaaacactcatcctagtgttccttgaggtggtctgattagcagctaatgggtttacaacagctttcccttttcaaatttgatttcagaagccatcagctgcatgatttgttgtatgtctgaatgcttgaagtgaaggttgatagttgataggagctggctgattctggtctataagtgtggctgggctgacaaacaggcatccacctacttgggctgggtcccgggagcagcctcaggaattgagattcctgcatctgccttcatggtctttatcttccaggcctccctctccctgtcatggctcaggcggggaccacggcagagggtgggccacaccatctttcaagggcagctgggccccttctggcagctggacgaaccttattcggtgcagtggctcatgcttgtaatcccagcactttgggaggccaaagtgggtggatcacttgaggtcaggagttcaagaccagcctggccaacatggtaaaaccccatctctactaaaaatacaaaaattagccaggcatggtggtgcatgcctgtggttccagccactcgggaggctgaggcacgagaatcgtttgaacccgggaggcggaggttgcagtgagccgtgatccatcactgtactcccacctgggtgacagagccagattccgtctcaaaaataaagaatgctgttcttcctgggcagagagtttctctgttctggaggtcatccagtagcccggccccaaggtgatctctctggatgggtgaggggaggaggggtctcctccagctggaagcatcgaatcaggactagcacttcctaagagcacgtggcccagaactgggctaaaaatagtacaatttttaaaaattacactaagctttgatttcagagtgtattggtttcctggggctgctgtaaccaagtgccacaaactgggtggcttaagacaacacacatttattctctcacagttctgaaggccagaaatcccgaagcaaggtgctggctgggccatcctctctcccaaggctccccggaagaagctgctcttgcgtcccctcattctgatagtcacagcgcccctggtgtctttagtttggagctccaatgtctgcctctgttttcacgtggccttttccccatgtgtctgtgtctctgtgtccaaatttctctctttttttaggacaccaatcactagataagggccgaccctcctccagcatgacttcatctaaatttgactgcattcacaaagaccctatttccacgtaagggctcactctgggattccggtggacatacattttggaaagacactgttcaacccaatatagagtctttcctgttttgaagtaagtttttgctaaattcaattttagaatgccttcctccacttccttgagcttggatagtttagaaatttgaaaatttgcctgttagggtaatctccgtatcttaacataatgtaagtttattttggtcacgtgaagttcaaaatgagtgatcttgaggggcagttggtgtccatctaagcagtgatttgggggcctgagctccttctatgtgggatgccccaatcttccatgtgggaaccctccaaacttccatgtgggtcccaaggtccctatgctcccctgtctcaagctgaaggggaagagcatggcgtgtggggagccaggccaggaagtactgctcatcctgtccatgcgtattcactgggccagaattcagctacaggccacagtgaagccaggaggggtaggctggccgtgcacccaggaagcagaggaaggggttggggaagagccgcagctgaggctggcgagtcaggatggcgcctggagggcagctcctcctaggactcatttccctttgctttccccccttcttccgcctctccaccttgctagccctggcgggtctctagtcaagagggtcagtttccaaacctcatggcacgagacccttccccactgacatgcaaacagcaaaggagcacctcccatttaaggggagactgaatgatcaaatgctaaaggaatacatctttgggggtgctgtgaacgccctcagtgaatctgggtgatccagcctggtggattgtgggggccctgaaggtgcgcttctcactaaacctccctctatgcccactaggagcccactgcatctcagagcaggggatggaacagttcccctggggcggggctggtgcttaggaagctgggcccaggtatcctggacggagtgcttggagtcttgtctgaacaggatcctcaggctgtgccacacagtcccagggcagattacacttgacacctgccccctcactggccacttcaccttgccagtggttttcaaactgccaggcaaggccagttgaaaccagtgcttaaaaataaaacagggcagggtacagtggctcatgcctgtaatcacaagaatttgggaggatcccttaagctcaggagttggagaccagctggcaacatagtgagactttgtctctactaagagaaaaaaaattagctgggcgtggcagtgggtgcctggagtcccagctacttgggaggctgaggtgggaggattgctagcccaggaggttgaggctgcagtgagccgagattgcaccactgcatccaaactgggtaatagactgagaccctgtctgaaaacacacacacacacacacacacacacacacacacacacacacaaaacctactagaaaaataccaggtacatagaacacagtgagagaaagtactgtgtcattaaatcttgattccatgtttatatgtatattttctgggttgtgatataaaacatttctttccaagtgaggcaatcaaaaactgaaagctggccaggcacagtggctcacccctctaatctcagcactttgggagaccaagatgggaggactgcttggggccaggggttccaaaccattctggacaacatagtgagaccctcattctataaaaaattagtttaaaaaattaatttaaaaaattagccaagtgtggtggcatgcacctacagtcccagctacttgggaggctgaggtgggaggatcacctgagcccaggaggttgaggctgcagtgagctatgatcatgctactgcaccccagcctgggcaacagagtgagaaagatcctgtctcaaaaaaacaaaccaaaccaaagaaatttgaaagccactgtcctatgtggaagaatttggaagtcaatgataacacagggaggtagtaattattttccaggtttcagaagtgcttgtgggtcccgataggagagatgctgtgatggtgtgaggtcaaggaggactctgggctgggttgaatcggggctgtaccacttccctcaggaggtccttgtgagggcgactccattgcctgggcctccacttttcatctgtaaaatgggctaaatatctaccttgatggggaggaggaggatgaaatagctcctcactcttgaatgctccctgtcctaggatttgttctgagtcttttatgtatattacatcagtctttcttcacaatatccctctggttaagtgctagtaccattagtttatcagtacaggtaaggacactaagacacggagaggtgaagtcacctgcccaagtgagctgatgtcaatgaaaatctgtatcatgccaaatactgtgtctggcacatagcaagcacagagcaaattttaattttcttacccttaattttgtttcaatcgctttaaaggatcctcagatataggcagacaaacaagctggtggaagatgtgtgagaagcacacttcaaactgccaggaagctggcttctatggagtcccaaagtgtgaaattagctcctcttctgtgagggtccctggaaacagtggctgctccctgcaggaggcagagtccctgcaagccctactcttcagcatcagaggaactgcaagggaagtcaaagaaaggggaccctcccctccagcccttaggggaagactcatcgatggtttcagggaggaaagagaatgatgggcctggctcacagtacactaccttcttgctggattttaaagattagaggcccaggaacccccagccctactccacaccctgcaatacagatcagcttcaaggggtctccacctcccctgcccacgatggccggccccactcctccagtagagactgtgggccccactgtctggaggccaagggagaacagagctgcttctccctgggggagatcagacaagtaattagaccaaactgcaagaggcagctatgtcattgcttctcagaaatgataaacagcgcaaagagaggattgcatcacttcttcccagggtcgctgggacatttgctctcagagtccaagctgggtcgcattttaatcagaggggggctgtggactgattccctgccgagtgcagaaatgtttcatcagcaattagtatgagcactccaaaaggaagctacacgttctccttgccttgttcccacgtttgcttgttccaagtcgtgtctttatactatcttaactatataatgtcatttatgccatattttaaaatagttgtcttcttatagaacccatgactttgtttgacttcattaacaaaacttagtaatttaccttgcacagagcctgcccatatgggatatgaaattagtatttgcagaataaaaagatgttgatgacaataataatacacataatgacataataatattaaagtaaaagctaacttgcgggggccctctcttctgcctcctgtctgaagagggctgcctctgcagtgagcctggacgtgggactactgcacacatgaccctgcggacatcaggccgggagcaggtggaggcgggtggcggaggaagtggtagaggaggagaggccaggagctccctgagccagcgctcccacagaaggaagttcatcagaaaatcacagagggcctgggacccaaggtcccccatccctcaccccacccaccccatcagaggtttgttcccgagtacctgtgttttaaagtgcccagatggcctccagctgcccactctagcacttacaagtttggagtccagggtccccagaccgtggggtggcagtgaccacactggcctcctgaagtgggcaggtcagaggatcccaggcctggctgctcagagtgctgtctgccagctgggggtgacattcctgtcctggctgtgactgtcccctcagcttccgccttattcacccctgatgggaggcagaggtggagccaggagagctctgctcatgactgtgctccaggaggctccacctccgtgtgcacccagaaggcccacaggagagatgttgtagcctgcaaagcactactgcctgcacgactgcacggccggctccacaggctcctcggaaacgacagcaggagcaaagatgagggctacagtgccaggtgaacacctgggagccgtctgtgtccatctctgagttctattcgtttgctaaggctgacctaagaaagtgccacatactgggaggcttatagcacacaggtgattttctcactgtcctggagactggatgtccaaggtgtgcaggctggtttctccgaaggcctctctccctggctgcaggtggccgccttcctgctgcatccaccctcggcctttcctctgtgcaacagcgtgcctgcggtctcttcctcttcatataaggaccccagtcctagtggattatggcctaccctaatagcctcatttaacccccattccctccttaaaggtactgtctccaaatacagtcacattgggggttagggctccagcgtatgaatttggggggacaccattcagtacacagcaggaggaaaatcactttcacagtcacacagcacttccaagctgtgtgtgttgccttacgtgtccagcaccatgcgtgaagtattgtcgcagctgttttcgttaggatgtgtgggaagagcacatctgtcatcagttccagcccccagtgaccaagaacacgtccctttggctctgcctctggctcacactggactgggactagagctcacagctgcaggtgccaggcctgagggctgcaggcttgctgccaggcccagggcatgggctatccatcccatattccacccaggtgcagacagaccaacatgagtacccaggagagctgcaacccctgggcgccaccgagaccccctctcagcctggccccctccattctttcacttgagtaatgcaggttctctaggtgctatatacagtgctttgcaaactcagcttccagctttgtgcaaagagacccttgtgaagggggtccttagactacctttgggtttggcaactcgctagtaggactcacagcactaagaaaggctattagatttgtgcttacactttgaaaatacagatttaaattagcaaaggaaaaaggaacatagagcggagtccaggagaaactcgcacaagcttctggtgtccttgccctgcggggctgaacggatagcgtttattttccccagcaacgatgtttcacggcacacttgaggtgttagccaccatgaaagcttacctatgcactggtgttcagggttttcattggggtcagtcacataggcatgcagtgcccatgtgactgacctcggctacttggacctcagcccaacagaggtgaaattaatagagcatggcccagagcctcgggcacgtgtgaacaggctttcatcataaatcacactgttggcataaactaaggatgtggcccaaggcctcagatacacaaagccacccttatcaggagggacactccaaggactcaggggtcatctcttcggagctgatcaaggctgtatgcagggtttggtcaactcagatctgctgagtcacccttgacatcacagctgacatccctaagtctctttggctgggacatgtgggagctgctgctgtcagtgtcagaggctttcaatttgattcatgtttgacagtatgatttgggagaaattatatattttatcctaattttcatttatttcattatcagtgaagcagaacaactctctacgtgttttattgccatttgaatttcttgtgtactttgtctagtcatttgttcatacatatgttgagttatttacatttttataatttataggagcccttatgaattgtgcacataagctctttgtcatatgtggcaaatacgcttctactatttcttttaactttattcttttttgtgagtgatacagaaatgtatatttttgatgtagtcagctggtcaatcttttctgtcatgatttcagatcttagtgttaagatcacaaaggttttctgctccccaaactatatgctgtccaatatatcttctcatgctttatttttaaacacgtaaatatctgatcttttggaatattgtattataatatatttattatgttatgttatatgatatgatattatacatttcctagggctgttataacaaatcaccacaaactgagtgacttaaaacagcagaaatttattctttcatggttctgtttgcaaggaggcagcagggctgtgctttcttgaagggctctaggggagcatctatctgttccacggctttctcttcgctttgatgtcaccagcaatctttggcttatagaagaatcacttgagcctcggcccctctgtcttcacacggcatcctctttgtgtgtttgtgtctcttttcctcttcttataaagatgtcagtcatattggattagggccctcctaatgacctcatcttgattacaactgcagagaccctatttccaaaaaggccacatgcactgataccaggggttagaacttcaatgtatcttttgggaggacacaattcaatccataacatatatggtgtaacaaaacttcatttgtttttccaaatgcttacctaattgtcgtaatgtcatttattggacaatccatcctttatccatgggtttatttcaagactgattattctgctccagtaatgtattggtcagttctgctgaggtcacatactgtttgacaaagtattggtgtataaccacccaagataagcaattatggaaggaaattggagggaaaagttagctagcctcgcactgttagtatgatcagtctttcccagtcgtacagtctataatgggaggcctgtctgaaaatacttgcacttctcatttttatgcccttgtttggacttgggctgttcctgcaacagttggttatgtctgataaaaaaaaaaaaaaaagaggaactggccaggtgcggtggctcacgcatgtaattacaacactttgggaggctgaggctggcagatcacttgaggccaagaatttgagaccagcctggccaacatggtgaaaccccgtttctactaaaaatgcaaaaacaaacaaacaaacaaggaaacaaaaaattagcctggtgtggtgatgcgtgcctatattcccacctatttgggagactgagtctatgagaatcacctgagcctgggaggtggcggctgcagtgagatgagattgcgccactgcactccagcctgggtgacaaagcaagtctctgtctcaaaaaaaaaaaaaaaaaaaaaaaagtaacttctttctttcatagccactacactgatatagggtttgaaatattaagagatactagttttaaacatctgcccagagtagtcctccaattcctggaacaatccagaagtgtacaaattctgacagagctattagaagccataccaatgctaagggtttaatggccaagagaaactcagtcactcctttaacatggatctattgagtgccaggcattgttctaggtgcaggagctacagcaaagcctgggacagacaaggctctctgtttcctttcagcttacatttcaatgggggaaagacaaggataagacaaacctaaagaggtacagaataccctctccagaagtaaagggaaagtatgtcaccttgaagtcctgggcagaatccgatccttttcacagctttatccatcttgttgaaatatagattattggcgacatccccaaaaagagagttgtagaagagaaacgcactggcagaatgacaggcaggtattagtgtggatgacaattgagtctaaagacattcttaacagcaatcttccattgatagcctactttattagttcatcagaattttcattcccatttgtgagacaggggaaactgaggatcagaaagattatctggtgatttgatttctgaaaagataatgcttatttagcaattcctccaggaagccatcagagtcctcatccatacaacagatgcgcagtaagtgatgaattttgctgtgaacacctgagttggaattagtcattgattgggctccactccatgagcaaatgaggtgagggggccagatacacacagataatatattttcttatttcttccattgcttgtccatgttcccatggattttttttttttttttttttttttacagagtctctgtcacccaggctggagtgcagtggcatgaccttggctcactgcaacctccacctcccagattcaagtgattctcctgcctcagcctcccaagtatctgggattacaggcacccgccatcacgcacggctgatttttgtattttaagtagagatggggtttcaccatgttggccaggctggtctcgaacttctgacctcaggtgatctgcctgcctcggcctcccaaagtgctgggattacaggcgtgagccaccacgcccagccttccatgaatatttttaacattttactttgatataattttagacttagagaaatttacaaaaatagtatagagagttcatatatatccattatctagctacctataatgttataaatgtatataactatggaacaatgctcaaatcatatatatccattatctagctacctataatgttataaatgtatataactatggaacaatgctcaaacccaggggaaaaactttgatacaagactattaactaagctacagacttatctgaattacactagttttctccctgtgaagtaaaggattaactcagcaggcttggggtgttcaaaccctgcatctcccagagaaaggactggcccttgactaccttctgggagacaaactctaagcccttgaaatatcctgcctgatgacagtctttgtttacttgggcccttgggccctgtcagatagtcggtaataacagcgtgatttatggtggggagtcttggatcttgctgtatccgtttgacctcttgaggaactgcagactgagtaactaaggtcagctatgaggtgttccatgcctctataactgatccctaataaaaaacctgagccccaggctttgagtgagcctccttggttggcaatactttctgtgtgttgtcacacatcactgctgggagaattaagtgctgtctgtacagtttctctgggtgaagacaaccagaaactggtgtttgtctctcctggattctgccctctgtgccctgttccatgctaactttaatctgtatcctttactgtaataaaccataactgtgagcatgacagctttttaaagttctgtgagtccttctggtgattcactgaacctgagtgtggtcgtggggacctttggcatgctacctaatatccttttctttctttcttttttttttttctgagaaagagtctcactctgtcacccacactggagtgcagtggaatgaccttggctcactgcaacctccatttcccaggttcaagcgattctcctgcctcagcctcctgagtagctgggactacaggcccgcaccaccatggccagctaatttttgtatttttagtagagacagggtttcaccatgttggccaggctggtctcaaactcctgacctcaggtgatccgcccacctcggcctcccaaagtgttgggattacaggcatgagccaccacgcccggccctaatatcctttttctattccaggatacaatccagcgtcctttattgttggtctccttcatctcctccaacctgtgacagttcctcagtgtctttgtctttcgtgaccttaacacttttggtgactactggtcattttgtagaatgaacctcaatttcagtttgtctgtttgctcatgattcattgagttcatgtaatttgggaaaaaatgctttatatcagataactgggatttttaaggagaataagctcttcagtacccctgtacacacacacacacacacacacacacacacacacacacacacacacacacacacacacacactctctctctctctctctctctctctctctctctctctctctctttccctatcagctggaattccccaccacactaaggctctcttgcaacactggctctccacctctactttcgctattcagttttattgtcaaacctcggatgaaagagaaccagtggcggccagtgttaaagagaagaactcagctttccctgttaacagaggcccttgtgcatctggtggtcatagcactcctcacattccttaattgaccctcaccccagatcgctggagcagggatgtggcggacattgactcttttgtctgctgagggtaatagtcaaccttcttctgggagatgttccttcttcccaccataaccacatggctctaaagagagctgccatgatctaacagactctccccacgtggccaccactgattggtcagagctgggcacctgaccctattggggccaattagagcccttccctgggatttctgggcttgagaggaagcagcacattcttcccctggagggtccttgcttgtggaagagccaggctagagtaggaggagttgaattcagacagaggcggagatgagcactggagagggagcctggctttgtcccaggtgtatctggaggcccaggtatgccctgcacccttcctccatgatgggagcctcactaatacatagaccacattccatcctgtctgcatacccgacacatggaaaaggctggacactccctacatctcatgattagccagtgaatgaaacgaaaagggccgagtgatacttcatcagcattgcagtttttctcacggtcctctctgtctttatgtttccatctatgggatgtagtaaatcagaaccaaacatgttgagcagcattcattttaacaggcgtcttcaagagactgtctacgtgattagcaaataccatctgcccgcctaatgaaatcagaacagccagtgttttccatcctcaactcagggattaaagaggaaaagccggtgtaagcaggtcacctgggttagcgtagctgtggagaggtgcgctgagcagattgcacagctcagccccgcccgagttaagaggagtcaggacacaaccccagatgccaaaggaaaagaaaggaagcaagacagaaaggagaaaaagagagagacagacagagagaaagagagaaagagaaagaaagaaagaaagaaagaaagaaagaaagagtctatattttacttcctgaacagctcattttataatacataaataattcaagacaaaataaattggttagaaaataataatgtttgtccactctatggctacggctatacgaggagcagaaataggaaacctgtgtatgttttgccaaaagagaatctgtttgctcatttaaactttttccttctgattataaaacatacacattcttttatggataactttcaaaataagggaaaatacaaagtgtgtggggcaggcatcactgagcgtagggagagggcgtggtcattctctgctcacgcccaccccggtgagggctgtgtctgggtgactggcagggttgggggtgcttctggaacccactgagggggcttttgggaaggggatgcaacggggaagagagcttggttctcaataatctatcagcttttggaacagcaacgttcgtttccttaggctgtgttagtttcctaaaactgtcctttaaaaagtaccccaaactgggtggcttaacatgacagaaatttattctttcacagttctggaggccggaagtccaaaatcaagacgctggcagggctgtgctctctgaagcctccagaaaagatttctcttggcttcttcctagcttctagtggttgccagcaagcattagcattccttggcttgcagctgcatctctcgaatcttctgtttctcgaaatcgctcgaatctctgcttctgtttccttgtggcgttcttccctgtgtgactatctctgggtatcttggatagtcatattggattaagggtccatcctgcacaactatgaccctgacctaacttaactaattacagctgagtgtggtgactcacacctgtaatcccagcactttgggaggccaaggagggcagatcacttgaggtcgggagtttgagagcagcctggggtctcaaactcccgactcctgaggtctttgcagtaactggtactcaagggaaatgctgaagaaaaaaggcggccgggcgcggtggctcacacctgtaatcccagcactatgggaggctgaggtgggtgggtcacttgaggtcaggagttcgagacatgcctggccaacatggtgaaaccccatctctactaaaaatacaaaaattagccaggcatggtggcatgtgcctataatcccaactactcaggaagctgaggcaggagaatcgcttgaacccaagaggtggagttttcagtgagcaaagatggcgccactgcactctagcctgggtgatagagcaagactctgtctcagtaataataatgataatttaactaattacatgcaccacgatcttcttttcaaataagttcatagtctgaagttccaggaaagacatgagttcttgggacacaatttcagtccatgcagcctctcttacccacacaaacctccctggcactgtggagtggagggcagcatggccccatcacggagaaagtctcctccgggtggtggggagtgttctgctgagaccctaccaggctctgcggaagccagggcagatccacagtggcagtggcctccgccggaacatttggccattgctgttctagaataccacaggaagttctggccttggctccagaggcaacaggcctcaggggcccaccctgtgagccccaaaaagcagtctaggtcctagggggtggttccagtgggccaccagaggcagtggcttcggtggggctgtgttctcgatcttttagaagccctcacagcactgtgcactcccttcacaataccgacaacaattccaaggaataaataaccatgaagttagttctttagtgtctgtctcagcaataggatgaccagctgtctgctaagtggggccaccaacttgtctagtttgtgctaggccagatttgcttcagcaccgaaagtaccacatcccagaaaccccctcaattcccagcaaaccaggacagctggtcaccctccttagcagacagatgggaatctcatgtgcagagccacggtgtctatctaatccactctatctcctgtgttcctgtttgtcaatggtaccttgcacagaacatgcatccaataaatatttgctgaacaacaatcataataatgattatctgcaatgctcagtaaatatttgccaaatgaatgccccctgccagtaaataaagaattctcttcagcattttaatatgttaccgataaatgacaccaactggatttacagactcatccaggaagcaaagagatttttgtccaagtagaaaatgccaagtagggtaagtttagcagcattcaatcctctaacaaaagatcagcaaatgtcctagagaggttgggtctgatttcctgaatccgtctttaagtggagattatggatttccagatcctctcagataggaggggccaaagcaggagggacaactgctggacagccgtagcggtgggaacgagagcttgcattgcacatcccaacacagcagtctcacaaaccttcccttggatgggatacactagactgtagacatggagggatggtgtgcttctctgtttttttgaaaatgagtctcactctgttgcccaggctggagtgcagtggcgcaatctcagctcactgcaacctccacctcccaggttcaagctagtctcttgcctcagcctcccaagttgctggaattacaggcatgtgccaccatgcctggctaacttttgtatttttagtagagatgggggtttcaccacgttggccaggttggtctcgaactcctggcctccagtgatctgcccgcctcagcctcccaaagtgttgggattacaggcgtgagcccctgtgcccagcctgatgtgctttccttgccttgcctttcctctttctttctttccctccctccctccctccctcccttctttcttttctttctttctttctttctttctttctttctttctttctttctttctttcttttctttctttttctctctctctctctttctctctctctctcttttgagacagtttcactcttgttgcccaggctggagtgcattgacatgatctctgctaactgcaacctccaccttccgggttcaagcaattctcctgtctcagcctcctgagtagctgggattataggcacccgccactacgcccagctaatttttggtatttttagtagagatggggtttcaccatgttggccaggctggtctcgaactcataacctcaggtgatctgcccacctcagcctcccaaagtgctgggattacaggcatgagtcaccacgtctggcctgatgtgcttttcttaaggatgcacgcaaagtagggctttgcaaccaggccatctgtgtgcttctttactgcgctgttctcccatttcacttaaccacagccacagcaatgaagcccagtggtcagtaccttcctgagcttgaatccaagctccaagtcgtctagatcaatctgtaactaagcagtggccacttagaccattgagatgtgaagaaagagccagcctggcaggtcttgcttgctcgttgcatgtctccagggcagcctagaacaatgacccttggccagccctggtgagtgcagtccccaggaaggttttgatgtctgtgattaatgattttgttctatacctctggaggaactggccacatgcaaccagcttgtcaggatagtttgcacaaacatcaaattgatgatgtgtacgtggtttcactgctggggtcctgagtttcacttggcatagctgatagctaagcagaatgtgtctatgtgatcaaccacccgaaaaaccttggaccctgagactggcatgggtttcctcgggtcttccacacatgtccttggagttctctgccagacaaaaaccacattctgagtggtctcagatgaggaggcatgaaggagcctgagctggactgttctggaatgcaaacaatgcgtatcttttcctgtggccttttctctgcatcctttgctggaataaatgttagccatgcatataacttgctattgagtcttgtcagtctttctggaaaatcaccaaacttagcacctcaacacatagaagaaaacagggatgctccgcccctgcttatcctgccggatgctgcccttgccccttccccccatcccccccaccccatccctgactccacccaggtttgaataagggctgtgggaaacaaggtttagaatggttaccgacaaaaccagagctggagttctaacccccgtggaggtgggtttcctctttggctcacagccccagtgtctacccagcaggaaaatgtggcaggaaagcatgaggcctagggcaacagggggcaggaggttgcggatgcctggggagcagatttcagggttgatagacttttggaatctctgggatttgtgaactctggttaatttctgtaaatggagccacaggtcttccccggatccctgatacttattactggctcagccaagcaaacactttgggttggagtatcctctagccctgcaagtctctgacctccacatgtgtgcaaatttctgttttacagtccagaagtacattgcaaattcattctctctctccttttatctgtctttatttattttatcttattattattttttttgagacagtctctctctgttacccaggctggagtgcagtgacgccatctcagctcactgcaacctctgcctcctgtgttcacgtgattctcctgcctcagcctcccacgtagttgggattacaggcacgagctaccacacccagctaatttttgtattttcagtagagacagggtttcaccattttggccaggctggtctcgaattcctgacttcaagtgatccgcccgcctcggcctcccagagtgctgggattacagtggtgagccactgtgcctggccctatctgtctttaatattctgtaggtataaactgatgagcacaaccatggacagaaatgtcaataaaatgattaaaatgtaagataactaaacataccaataaaacaattttattaggttggtgcaaaagtaattgtaggtttgctatttcaatggcaaaaactgcaattacttttgcaccaaactaataaaaagcaagccactcaaataattacttacacacttgctattcagataaagccctgacatttattttgcataaaaaataaatagcttataggccaggctcacacctgtaatcccaccattttgggaggctgaggcaggaggattgcttgaggccaggagcttgagaccaccctgggcaacatagcaagaccctgtctctacaaaaataaattaaaaaaaaaaaagatagtttatccagaatagccaaaacaattttgaaaaagaaaaacaaagtaagaagactcacacctcctgatcacaaaacatgctgcaaagcaatggtaatcaaagcagtgtggcattggcataggataaacatatagaccaatggaacaaaactgagagtccagaaataaatccatgtgtctatgggcaactgaatgccaagaccattcaatggggaaagaatgtttttttaacaaatggtgctgaaacaactggagagccacatgcaaaagaatgcattttagacccataacttacacctatacaaaaattaacttaaggaccaaagatttaatcataagagctaaacctctaaaacacttagaagaaaatatagggaaaaccatgacgttgggtttggcaatggcttctgagataaggcaccaaaaacacaagaaacacaagaaaaaaataggtagattggactttactacaatcaaaatcttttttttccatcaaacgataccatcaagaaaatgaaaagacaacccacagaatgagagaaaatattgggaaaccatgtatctgatgagggtctacatccagaatatgtaaagaactgttacaactcaacaacaataagaccaacaacccaattcaaaaatgggcaaagaggctgggtgcagtggttcacgcctgtaatcccagcactttgggaggccaaggcaggtggatcacttgaggtcaggagttcgagaccaccccggccaacatggcgaaacctcgtccctgctaaaaatacaaaattagccaggcatggcagcgcatgcctgtaatcccagctactcgggaggctgaggcaggagaatcgcttgaactcaggaggtggaagaggttgcggtgagccgagatcacgccattgcactccagcctgggcaacaagaacaaaactctgtctccaaaaaaaaaaaaaattattattattatttttttaaaagaatggctcttcttcctttagccaacaggacatgtccacttctgctttctctgtcctcccattcccaccccaacactggttgtcagtataagaaaggcaaaaaaaaaaaaaaaaaatagccaggcgcggtggctcacatcccagcactttgggaggctgtggatcacctgagcttgggagttcaagaccagcctgaccaacatggagaaaccccgtctctactaaaaatacaaaattatctgggcgtggtggcacatacctgtaatctcagctactcaggaggctggggcaggagaattgcttgaacccaggaggtggaggttgtgctgagccaagattgcaacattgcactccagcctgggcaacaagagcgaaactccatgaaaaaaaaaaaggaaggccaaaaaataatttatttttttatttttattttttgagacagagtcttgctcttttgcccaggttggagtgcagtgttgcagtcttggctcactttaacctctgcttcttgggttcaagcaatcctcctgcctcagcctcccaagtagctgggattacagacatgtgccactgtgcctgactaattattgtatttttagtagggacagggtttctccatgttggccagcctggtctggaactcctgacctcaaatgacccaccctcctcggcctcccaaagcgctgggattacaggtgtgagccactgcacctggccaaaaattgggttttacaataaaagaaattctggtccaatagagcaaagattcttagccagattcggatctcagatctcttgtgaatttgataaaagcagctgtcctccttagcttggaaaaatataaacacacacagagttgagtatgcaatctcagtgggttcatggatccctgtagcccatattccgactccaggttaagactctcacaggactgagcacatccagcatccacgctgtggcttctgaatgccattctccagtgaaaggaaccagagctcctcggagaaatggtcattccaggaagagaaagaacaacatgagcctggagcatcttgcagtgccagaaattaaggaaacgctgaaagaaataaaggagaactgttcaaagggcacaggggccagctgaggagctcccactgaccagatccaagacagttagagaatcagaatacataatgacagtgatgaatggcagcccatccaaatgcataagaatccgtgtgtccataatgatcatgaatgagtgaatgaagaaggggaagctcttcctcatagtggaaagccaactaatcatcacagaagaaagaataggcttagagaagccactgttttacaaccataattggtcaccgagtccagcaagaatccttaataaatgctaaagctcttggttgcgaggttggggaggaaggagacattgacctagtctcaaagtccctcccacagatgacctgttagttacaatggaaaagagaagattgtacagctggcagacaccaccttcaactcaagtcaacgttgtcactaagaggggactgaggccaggcgccgtggctcatgcctgtaatcccagcactttgggaggccgagatgggcagatcacctggggtcaggagtttgagaccagcctggccaacatggtgaaaccccgtctctaccaaatatacaaaaaaaaattagctgggtattgtggcgagtgcctgtaatcccagctacttgggagactgaggcaggagaattgcttgaacccaggaggtggaggttgcagtgagctgaggtcatgccattgcactccagcctgggtaacaagaacaagacttcatctcaaaaaaaaagctgggtcgggggtgtgggggactgaaccgaaccgacatcatgtgcctgtgatgggacgcacaaggaatggagacttcattgtttattcccagcaaactcaaatctagtaatgaggagacctcagatggccccatggggcagagaatctggggaagggcatcccagatcttccatacgattctcttcagtaacaacttctgcagctcctgcaaaaatatagtgtcgtgcaagacaaacaaagctaaaagacagtgtcagatgaagggagaccaaagagaattggccactaaacatgatgtatgatcctggtttggatcttggactggaagaaaaatgctatgaagacatcattgggtcacttggtaaccaggtaaccacattccagcaatgagaaatttcctggctcagataactgccctgtggttatgtgagaaaacactcttgtttgttggagatctatgtggaaatatttaggggtaaagggtatgatgtctgtaatctgctcctaaatggatcaggaagaaaaagagatgtgtatttataaaaagaaacagagatgatgtggccaaatgcggcaaaatgttgacaattagtatatccaggccaggcgccgtggctcgcacctgtaatctcagcactttaggaggctgaggcaggtggatcacctgagttcaggagtttgagaccaacctggccaacatggtgaaaccccgtctctactaaaaatacaaaaattaactgggcttggtgatacgtgcctgtaatcccagctactcaggaggctgaggcaggagaatcacttgaacccgggaggcagaggttgcagtgagccaaaactgggccattgcactccagcctgcgtgacaagagtgagactccatctcaaaaacaaacaaacagaaacaattagtatatctgggtgaagagtacatgggaagtttttatgtttcttgcaaatcttttgtaagttagccatagttaacataaaagttattggccggacgcagtgtctcatgcctgtaatcccagcactttaggaggccgaggtgggtggatcatgaggtcaggagttcgagagtagcttggccaacatggcaaaaccccatctctactaaaaatacagaaattagccgggcgtggtggtggttgcctgtaatcccagctactcaggaggttgaagcacgagaatctcttgaacccaggaggcagagatagagcagtgagccgagatcaagctactgcactccagcctgggtgacagagtgagaccccatctcaaaaaaggaaaaaaaagttatgttaaaaataaaaatcagtaaagtttttataatcaaaataaaatataataaaatttaaaaactctccaaaatctctgccataaaaactgtagagacaaaagtcagctcctttaggggtagtgcagcctgcagaagccaccacgtcggccaggtggtcggcaaatggcacagacgctcacttggctctgacaccagctggagtccctgaggctggagactgtcctggagagaagagcattgtttcctggcataagagaagtagaagaaaaccacttctgggatgaagtgagctctagtggaatccaagagcctagaggctccccatgggtccttagcgttagtggccagctgtgacccttccggtctgcagaccagctaaccacagggccaactgcactgattgagcccctattgtgtgcaggagcctgtgtgggctaggaggccccactggtggcttgcgtgtgtgtttgcatgtttgtgtgaacctcatttccctggggagccaagtgagaacgaccatcttgtcaaaatgccattgctagttgcgacaggtgagcgttgatggtacgacaggtgcaagaagctcttttatgccaaggaatattcaaaatatttcacttacattaagccattcaacagcctcctgcccagcagccccatggggtaagtatcactattgcctcccattttacagatgagaagtgaagtaaggcacctaaagtcaccaagatctgaggctcctggtcgacacaaaggtggcatgcccagcacaacaacacacacctcactctttggtcctgtcctcttggggtttttttgtttgtttgtttgtttgtttttgagacagagtctcactcttgtcgcccaggctgaagtagtggtgctatctctgctcactgcaacctctgcctccgggttcaagtgaatctcctgcctcagcctcccgagtagctgggattacaggcatgtgccaccacgccagctaatttttgtatttttagtagagacgtggtttctccatgttggccgggctggtcttgaactgacctcaggtgatccttccgcctttgtctcccaaagtgctgggattacaggcatgagccaccgtgcccggcctgtcctgtcctcttggaacagaagtcagctcgcctctaggaagcaggctccaagaaaacacaatcatggccgcacccttgcacagaagtcgtggctccctccctactggggcagtgggcatctcctggggtcaacgctcagttatgaatacattgcttaaacttgatcgttgtgagtttcacacccagttgggaaaaaagactggtttggtcagttggcatttcaggagtatctaaaatattgaagtgtatttaatatttcagtgtactagctcaagcttttgtgtgttttcataaaaaagttgctgccaaacatattttgaataccatttgtgaggacgtatggctctttccacgcctctcaaaggccagggaaagcagagttggaggaaacctcctttcctctccttctagagagtcatttaaaagtagtgagtactttgagaaaatgcttttgactcttggtccctttttttgagtattaaatcaattatagccacacagcaagcctgcatctccattcttcatccaggggccaccaaaaaaaaaataaagcagctgaacaaatataagattctgtaccatttccaccccctggcccccctgcccccccgccccccccacagcagaaatgctgcttgtttttggtcaatggtcaaatgataacctgaaagctcaagttcctttttttttttttttttttgagatggagtttggctcttgttgcccaggcttgagtgcaatggcgtgatctcggtgcaccacaacctctgcctcccgggttcaagtgattctcctacttcagactcccgagtagctgggattacaggcatgcaccaccacgcctggctaattttgtaattttagtagagttggggtttctccacgttagtcaggctggtctcgaactcccaacctcaggtgatccgcccccaaccacctgagcaattgcaagttgtaagagctttgggtcagaaatgcaggtgtcttctgatcacccaattgccgggaaagatgccacaacaacacaagagggaggccactatcagttccagcgtcatccccactagtaccactagggggtcaggccactctggccaccatggaatgctcgtatggtagccctaagtcatggttttccattcacagggacaatgtgaccaatgaagtaagcagtcaatacctttaggacatcaaggtgaaccataattgggacacagaagtttctggaagaggtaggcttgggcaaggcgggtgagcagcaggttgtgtttaccaaaaatggccatgatgctgccttctacactcgtgttcttctgcagtgtgactgtgtcattcccgcatgcagaagcagagtctctccatccctgggaacccagggctggcctgtggctcccttgtgactgataggatggagtagaatcgatgccgatgatgtcccaggctggcgtagtgctacaatccgaggccagggcagaacaggcctgatgctgaggcctggttcccttggaacgttcccttcaggaagttcctgctcagaactccgcctctgtgctgccagaagcccaaggtacaggaagcagccaggcactggggctcatacacaggcttggctgaacctggcttcccagggcaggggttaagagggaagaagcccctggaggatgtcagccatggccattcacagcttcctggctgaggcttcatcctctccaaactcctgacttgcagaatccctgggcatgggaaaatggttcttgtttgatgccatcaaatgtgggatgcttgttacgcagcatagataactatggtaaaccccgtgtcatgggcactgttgggtgatgcaggtctgggaatggggacatttggtgaggcaaggccctttggattctggttaggagagcgagttctagagctgcctaggttcaaatccagtctccaccacttaccagctctgtggcagtgggaaagtgacttaacctctctgtgccttgcacgtcttcctctgtgcaatggaggtgataacagtacacacctgggcaggctgtttgaggaccgagtgttgttagtgcccgaagagcaccaggctcacgggaaacgctcattccgtggtgtcacctctgatgggcacaggcctaggcctcgactggacggctggaagactgtgcaggtctagagggtgcttagacttggcaggcaattgtatttttttgtctcactaactaaactgggagaagacagttatctgtctgtctctcatcatctgtgcgttgagaatgtggggcatacagaaaatgctgtattttgactggaaggagttgcaagttcctgaaaaaagcctgctggtggaattgaggctgacatcaggcctgagaaggggaggggagggcattggggagtgagagggctgggcctgggcaaacgggttggtattgctttagtggggtgcacgcacatgtgtgtgtgtgtgtgcacatgtttgtgcctgtgtgtgtgtgtctgtatgtgtgtgtgaatagagagaggtggcccctagaaagggtgagagatgctcagtcaaaactcagatgtgagccagatttagacaatgaagggcccagtaggccacactcaagcaaggttgtggcagggatcatgatctgtattagtccattttcacactcctgtgaagaaatactcaagactgggtaatttataaagaaaaagagtttaatgcactcacagttccacatggtgggggaggcctcccaatcatggtggaaggtgaaggaggagcaaaggcacattttacatggtggcaggcaagagagcttgtgcggggaactacccttcataaaatcatcagatctcctgagacttattcactatctcgagaacagcaggggaaagacccgtccccatgatttgattacctcccactgggattatgggagtgataattcagatttgggtggggacacagagccaaatcatttcatgatccaagcccacattagccagggcagcgggcagcagggtgggagacgtgggaagggcacaaaaggaaacagagtcaagtcttcttccaggtgttctgcctgtgctgggggggccctctcacaccacctcctactcaacctgcagggctgggctggtgcatcaagagggaggtggaatctcattctccctgtgtgagtgcacatggaaatgtgatttcactcctggtttaacttttcccttgccctccagccctcagcttcactttttcgggtgaccaaataatgacaattttcacatcgccaggtttccttcagcatttgctgacggccgactgccttagacaccaaacacatgttatccagacgcctgaaacggccatgccctggggagctgtttagtagttttaaagaccttgaaaggccgggtgcggtggctcacgcctgtaatcccagcactttgggaggccgagacgggcggatcacgagatcaggagatcgagaccatcctggctaacacggtgaaaccccgtctctactaaaaatacaaaaattagccgggcatggtggcacgcgcctgtagtcccagctacacgggaggctgaggcaggagaatggcgtgaacccgggaggcggagcttgcagtgagtcgagatcgcgccactgcactccagcctgggcgacagagcgaaactccgtctcaaaaaaaaaaaaaaaaaaaaaaaagaccttgaaaatactttgatgaaaatgcttctgatgacaagcacctattgtgctgcagatctgttgtgtgccatctgccttcattaaagacggggatgtgagggttttcccataaagaatccgaatcgccactgctctctggtttggccaaagaaagagatttatattatcatcacttttggctcccaaatggttaagcatccttgcgccttcgttggcacatagcgggtacttaataaacgtttgtgggatgagagtgaatgaatcactagatggaaggcactggcagttaggaggagctcattaaaacctttctaatggagatctcccagcctgcagcggctgtgatggtgaacaccagccatgcaaagcgtatgtctgcttagtaccctgagtctacaaaccggagggaagagagccgagagagcaagcaacaagtaatgactgctgcccctccacaatcccacctgctcggcccggcatctgctacccggccctccacaccatctgcgcccagggggctggccattgccaagcctccccacgtggcctttccagaagacagtaccatcactgacctcactgtcattggccccattcgccggcagctctggacaccagatgggcctggcgtggagcctcattgctggtggttaagcagtttagctcacttcttacctcagcatctttgaggacccagcctgcccaggagaatgctcacttctttctgttttcctttgggaattctatgaggctgcttcaggcactgattcatcctgtacatttttctcccatgggcatgcaggcctgagtgtgtggctcactttgtgcagatggccggggcctcctgctgcagaccaggagaacacggcaggcaccagattcttctcaaccttcagaatgcaaaggtcccagaaaggagtcaccttgagagccgagatgcaaacttctgtgtcactaacgtttgaactgctttcaaaccttgtggcaaattgttttgcatatattcccattaacaaataaacaaaacaaaacacacttcagtcttggagggttgatttgaattctagaaacagctgagtcattcacagccgagtctggggcacaaggtgggtgagccaatttggataaggtatttttaggtgaaaaatgaggaatgactttaaagcaatccaactgattttcataagtgactcttagcctgaatttggtgagtgtgacagacatcttgggcaaagggagttgtattgttctagaagtattatttcccaagatagcccatgaagacattcattcagatgggaaaactgagaactttttttttctgccacttcgagaaagaaaattagtgttcttttcttttttctttcaaccaatcatattcatttatacaagtacacaagtactgtataccagaatgatcaaggtaatgtcccccaaaaagacattagaccatcctgtaaagatgtccttgctttagaaaggaatcaatttgttggtatgtgctgaccatttcccactttcttttctgtcttcatgcaagtagcagaggcccctgagtggcagaggtacaggattgacccttgttcttctcacctggcaaagccaccgtgccaggatgcattcactacctccctcctgaccaaaggcatccatgacatgctgagtttctagggcagacccatggtcagtccatccaacatccaagcctcctctctgccttaccaagagaaccttcattcaaccctgcaaaactcatcctcctggcagccaagggctcactgaatggaggcagaagtcaactgacttctgcaaaatcttagctttcccaataaaagacagacatgctcacagcttcctcttctcccacttcttactttctcaaagatagacatgatgtctggagctacagcagtgcatttgaaaccaagaggaaaccagcctgagaatgaagagccaacctgacaaagacaaggaaaagcctgcatgcctgatggcattgtccagcaacggaagcaagaccagcaatttgtgactgctgggcttctcagcatatgggacacacgagaccctctgctcctagcagcagatacagatcaacctcacacacagggtattcctttgtttaacatggtaagtgctgtgtggcagtgtacctggggaccaaacgcacttccgaacctcagctgagtctattcatttagagaaagggtgggaagaaccacgaacttaaaggctgataattctcatcttgagagaattctggaatcaataggtctaacatgtttagtttctgacttaaaatgcactaaggcagcggggtgtgatggctcacgcctataatcccaggactttgggaggccgagatgggtgaatcacctgaggtcaggagtttgtgaccagcctggctaacgtggtgaaaccctgtctctactaaaaatacaaaaattagccaggcatggtggtgggcacctgtaatcccagctacttgggaggccgaggcaggagaattgcttgaacctgggaggcagagtttgcagtgagccgagatcacaccactgcactccagcctgggcgacatagagagactccgtctcaaaaaaaaaacacaacaaaacaaaaaatttgggtcgggcatggtagcgcatgcctgtaatcccagcactttgggaggccgaggcagggggatcacttgaggccaggagttcgagaccagcctggccaacatggcgaaaccctatctctactaaaaacacaaaacatttagctgggtgtggtggcaggtgcctgtaatcccagctgcttggcaggctgaggtgggagaattgcttaaacctaggaggcggagattgcagtgagccaagatcgtgtcactgcactccagcttgggcaacagagtgagactctgcctcaaaataataataataataataataataataataataataataataaataaataaataaaattttgaattgacaaatgactcatgctgaggaggccctaatcttctcataggcggcaggacaggggattgagtgcttgtttagatttctgttctggggaggggcaaaaggcatctggtttttagtctgtgcctgctgtgtccgagagactccacctacatcacctcatttaactcccacacccactttgacaaggaaactttattctctcttttatattttctgaacctaagtctcagagaggttgagtaatttgcccaaagtcacacagctggttgagcagatccgactccccagcattgatctctcccacagcagcaacccagccttgcacataatgagacttcagtcataatcgcttttcttttcttttttcttctttttgaagcagagtctccctctgtcagtcaggctggagtgcagggttgttaacatggctcaccacagtcttgacttcctgggctcaagccgtcctcccacctcccgcgtagctggaaccacaggcatgtaccaccatgtccggctaatttaaaacatttttttttttccttacaggcagggtctcactttgttgcccaggctggtcttgaactcctgggctcaaacaaccctcctgcctcagcctccagaagtgctgggattgcaggcgtgagccaccgcaccctccatcttcttgatggaaatctgtcagtgaagaacccgcaagtgactggtaatgctctattttctcagtcacaaactgagatgcacaggttttatttttcttttggtggggacaggagagtgggagccaaaatttgtcactgtaaagactcccaccctcctgtcctcaccaaaagaaaaagaaaactttgcatctgaggttgcgactgagcaaacagaacattaacttagggaaatttctccgtccgtgcattaactgaaggaaactgccgtgttgctctctgcactatttagagagaatgtgagttaggaactgttggaagagacatgaatagatatgaaatttttgtcatgacaaaactaatgctgtgttaataagaaacagatgaaggacccatctgtttcattcctttctcttcttaagaggatatagccgaattatggttaagtaaccctgaggacagttacatgatagcctttctcatgtcaaatgtgtggaaagagagtgtgaggtcgaagtttcaggtattgtaaataaatatcttgtgacctgaacaactttttaattagctttatttctaccaaaaaaaaaaaaaaaaaaaaatccagaatgctgtactgcagccaagtgaatgaatacatgtaaggtgtctgtgtcagggctgagaatgacagggccgggcaagtccaaacctgcctcttctcatgccatcgtctcacatggcgcccctgaggaagtagcaggaacaggagaggggactggattgccccctatgggctgaattgtgtccccccccaaaattcatctgctgaagtcctaagccccagtacctcagtatgtgactttatttggaaataagattgttgcagatgtaatttgtcaagatgaagtcatgctggaataaggtggatcccataatccaatatgagtgggtttttaaaatttttaatttaatttaatttaattctattttaagttctgggatgcatgtgcaggatgtgcaggtttgttacatatgtaaacgtgtgccatggtggtttgctgcacagatcaaacatcacctaggcattaagctcagcatgtattagctattcttcctgatgcttgccctccccctgcccccaccaaacaggtcccagtgtgtgttgtgtccctccctgtgtccatttgttctcattgttcagctcctacttataagtgagaacatgcagtgtgtggttttctgtttctgccttagtttgctgaggataatggcttccagctccatctatgtccctgcagaggacattatctcattcctctctatggctgcataatagtccgtggtgtatatgtaccacattttctttatccagtctattattgatgggcatttgggctgattctatgtctttgctattgtgaatagtgctgcagtgaacatatgtgtgcacgtatctttatagtagaatgatttctattcctttggctacatacccagctatgagatttctgggtcaaatggcatttctgattctaggtctttgaggaatcaccacactgtcttccacaatggttgaactaatttatattcccaccaacagtgtaaatgcattcctattgctccacagcctcgccagcctctgttgtttcttgacttttttttttttttttgagactgagtctcgctcttgtcgccaaggctggagtgcaatggcatgatctcagctcaccacaacctctgcctcctgggttcaagcagttctcctgcctcagcctcccaaatagctgggtttacaggcatgcaccaccatgcccagctaattttttgtatttttaatagagacagggtttcggcatgttggtcaggctggtctcaaactcctgacctcaggtgatccgcccgcctcggcctcccaaagtgctgggattacaggtgtgagccaccgtgcccggcctgtttcttgactttttaataattgccattctggctggcgtgagatggtatttcattgtggttttgatttgcatttctctaatgaccagtgatgttgagcttttttcatatgtttgttggccacatgtatgtcttcttttgaaaagtgtctgttcatctctttcacctactttttaatggggttgttttttttcttgtaaatttgtttaagttccttgtagattctggatattagacttttgtcagatggatagattgcaaaaattttctcccattctgtaggttgtctgttcactcgggtgacagtttctgttgctgcgcagaagctctttagtttaattagattccatttgtcaaattttgcttttgttgcaattgctttttccctgcatgtgacagacacacatgcaggaagaatgccatgtgaaggcagaggcagagattgggatgatgtgtgtacaagccaaggatgccgaagatctccagcaaagcccaggagtgaggagagaggcctggaacaagttctcccacacagcctcagaaggaagcaaccccgtccacaccttgatcttggacttccagtttgcagaactgtgagacgatgcattctggtggtgggagcccccagtacacggtgctgggttgcagcacccagagccagacaacgcaccccacgaggaagctgagcttgacaactaagaggttgcagttttccaaggtggagacatgtttgctcatgtctgtccacgtttttccttttatggaatggagcccttggtacacgtcaggcaacttgctgaacttttagaaaactgatcacaccttccctgccttccaagagtcctcattcttggggacagaatgtacctcataacttggtgtgtccttaagactgtctccgtgttgagtgctgggtgattttaggagtatttgtatgtgtatgtccgtgtgtgtgtgtgtgtgtgtgtgtatgcatgcatgcgtgggtatagatgtgtgaatgtgtgtgtgtatgagagtgttgggtgtgaatctgtctgcatgtgcatgtgtatttgtgtgcatatgagtgtgtggctgtgtagaagtgtgagcgtgtgtgtgagtgagctctcacaggaagtctgtcaggggctttggcccctcgtcactctggaagtagaggctggagaaagagaaacccaccacagggtctcttggctacacatagacagggcggggtcttgctgtacctggggaaggtttgggtctgcgatggggcacctcaccctcaggaggagctgagtgtgtcctgagccccccacagcctgatcctcagggccggctgccacgaggcttagcttgatgccccgctcaccaaggaagcccctgggactggatccacaggaccaacaccaatgaaaaggggaaaggtgggttgaaacatttttgcaaggagaaaacactgcatagaactctattgtcttacaattggggctaatttaacaagacactgtatgtccacataacagaaaattatgcagccatcaaaagtgaaatttgaggaatttttagtgcctgggaagctgcttctgatggatggaaaatatcagagttcaaaatggcggcgacagtgtcatcagactcaggtgttgtacaaacttcctgggttcgaatttggactcgccactggccgggtgtgcatcctagggtgttaccaacctccctatcctggtttcttcattggttaagtgggaacaacaagagtaccaaccccacaggccaaagggtggcatttaaggggctcttgatgaaaaagccctgatttgtcgcatctagtgacttcggtggcaaatactcccataatggccaatatcacgctcccagtgacttaacaacctattgacagaatttctgaaaacttaagtcaccctcacaagccagccagggctaactccagcacagcacagctaggggctttggggattaaataaatacatgctttgagcaatgcataacacaaaagataaataggagctatcacgtccactgcatcctatttcgacacaaattgccagaaaaataagtaaaataaaaagaacaatgtgtgtgcaaaccatggtatgtggtggactgagggtggtgattacaactctgtccatctgaggtccaaaggataacttaaaatacgtgtatggctggttgggcgtggtggctcacccctgtaatcccagcactttgggaggctgaggcgggtgaatcaccagaggtcaggagtttgagaccaatctggccaacatggtgaaacctcatctctactaaaaatacaaaaattagctggatgtggtggcccgcgcctgtcatcccagctactcaggaggttgaggcaggagaatcgattgaacctgggaagtggaggttgcagtgagctgtgatcttgccactgcactccagcctgggcagcagagtgagactcttgtctcaaaaaatacatatatggctaaaaagaggttcactaaaatgctgagagtggtgggatcatagaccgtatgtgtaagttggcaatttgtcctagttttgcacaaggagcacatgtgatataatcatttaatgtcatttaaaggagggaggagttctgaaggtgggcgctctaactcttgggataggaccaagggaatgaagcccccaggggcttggggaaaggcgtggtcatcacagagagtcagggaggactgcctggggtggagagaggctgctgaagggcctgtccccatcaacacccattaggtgactcagctttcatgacaccttcactccttccaatctaaaggggaggctttttcttggcacaacctgcctcttagacacagtgagagggaatcagccgggctttctgtctgggcttgtgggtggtcctgacactggatgtgctgggttgaataatgtccccccaaaactcatatccattcatatctcagaatgtggccttatttggaaatagggtctttgcagatggggttggttaaaatgagaccattctggagcaggggggtcctcatccttatgactggcgtccgtatgagaaggggcactttgaagacaggcacaggggagaaggccctgtggcagtggaggcagagacaggagctgtgtggccacagccaggagcgccaaggctggcctggccaccagcagtgggcagagaggctggaagaggtcctcccttagagcctccagaaggaaccagtgttgctgacacctggagtttggatttctggcccccagaacggtgagaaacacacatttctgtttttaagctacccaatttgtaatgtttggttatgggggccccaggatatgaacacactgggcccaggccaggaagccccctagggtcccccccgcaggcccccaactctttaccttcgatcccttcctgccctccctatcctggggtcctccttgaagccacctccactcgaagccacctccacttgacgccatccccagcacccttggtcctctccccctaactgtagttctctccccgccaccccttcccccagccctccgtctcctccgacccgcgccctgggtcccctcctcgccccgcccccgacgtccccgggtcccctcccctcctctgccagcgtctccaccccgctggctaacgcagggctgagtcctcacccagcagcttagggcccctcagaactagagcggcaggagattaagggttgctaatttggaagcagggactgatgttctataaaaagcagggaggctttgggatctgtttggtttttaagtttctaagccattttagaaactcatcctacacacaaaatggtgaggtccgggggatctgtctctgcctcgccctttcccctccgggatcggtctcttcccctccccacctgcctcctgggaccctccaggaggagaggggcctgcagcagggagaggagtgtcctgtcctggaggaagagctgggaggagaggaccctcccacagttctgggtgggaatggtgggagggtcctagggcctcttgcgccagggcagaggtggagggggcgtggaggtgggtgagtggccccacagcccgtgtgcccaccacggccctgccaacagcctgtgcatttcagaaaagcatcatagcccgtgaggttgtggcgtctgtggtcccagtgctttgggaggctgaggtgggaggatcacttgaggccaggagctcgaggctgcagtgagctaagattgcgccacttcactccagcctaggtgacagagcgagatcctgtccaaaaagaaaagaaaaaggctgggcgcggtggctcacccctataatcccagcactttgggagggcgaggcgggcggatcatgaggtcaagagatggagaccatcctggccaacatggtgaaactcgtctctacaaaaaatacaaaaattagctgggcgtggtggcgagtgcctgtagtcccagctactcgggaggctgaggcaggagaattgcttgaacctgggaggcgaggttgcagtgagctgagatcgtgccattgcactccggcgtagtaagagtgagactctgcctcaaaaaaaaaaaaaaaaaaaaagagagagagagaggggtgcgggggttggcgagggggaagaaaagctttctaggagaagaaccccagggaatgagtctctcttgttgacatcattgagccctgggggaaaacattttgggtgggggccttccagagatgctgtggaagtaccataatacgtgccagggacacacatacagacatctgtgcctcttgaagccggggttagcgaggcctgggttggaagagcagcacagctttcttctgctacagaggaggcattcagtgctgaaaaagccagaatgttgaagatggctgtgaaatgtcattttactcattttcccatctttctcatcagggagccagggagcaagctcagtgactttggaaagcagctgtgtggacccacacgtgcacacacaggcacatatgtgcacgcacgtgcccacacacagccataagggaaagtatgtggttgtctcagctcagtagtgagcaggttacgtagaatctggaagccttgagtgaacccattccaattcctctctgtcggcggaaaatacactaagtggttttttgtttttgtttttgtttttgaaattcactcgaagtattttttctgcccatcacaagccatttcattcataagccaaacgttcctccctcaaaagctcgttccctgtgacgaggccttcgtgttctcagagaggaattccgggatgtttgtttggggacataacatctgctgtgtagctgtgaaaaggaaggatgcaaagccctcagggcaggaggcacccaaggcagaacggtgacagcagagtcacagggtggcccgcagctcccgccattcgtattactatatgtccccatgtaattaggtacagggaacccgggcagggggaccctggtgtggtgggagcgtcagcttagggatggccctgccccttgtcctctggagacttgaggctgctcctggcctctcaggacacagacctgggtgggagggcaggaggtgacaaaatcagggatgccccagcctggacatggcacagggagatgtttacggggcaaccttgtcccttgacgtcccttctcaggaaacaaagggtgtcaggctgtctagtggcaaacccagccctaatccagccctcgtgggtggggtggaagggtagtggggagcagggcaagatgtttggctctcagaaaaggtgccgcctgtgacaacccaccctccaaatgtcttttttttttttttttgagacagggtcttgctctgtcacccaggctggagtgcagtggtgcaattataactcactgcagccttgaactctcgggctcaagcaattctcccacttcagcctcccgactagctgggactacaggcatgcgccaccacacctggctaattttttattttttgtagacacaagttctcctccctatgttgcccaggctagtctcaaactcctgggctcaagtgatctttctaccttggctttccaaagtgctggaattacaggcacgagccacctcacccatccctaatgtctttttttttttttttttttaattgagatggagtctcgctctgttgccaggctggagtgcagtggtgctgtcttggctcacagcaacctcggcctcctgggtttaagccattttcctgcctaagcctcccaagtagctgggattacaggctcctgccaccaatacctggcctaattttttgtacttttagtattttagtagagatgggatttcaccatgttggccaggctggtttcaaactcctgacctcaagtgatacgtctgccttggtctccgaaagtgctcggattacaggcatgagccacggcgcccagcctaatgtcttcttttaaagtcagtttattgaaatacaatttttatttatatttctttaggtagcataatataattgatagtatcatataattctatgatacaatttggaacagaattatgtagtataatttactggtgtatatatatattattatcattttataaaatgagatagtataatctatgtagtataatatagtgtataatagtatgtaatttacatgatatactggtctatgatttttgactaatacatacaatcatgtgatcattgttatattcaggatcgagaacagacccatcacctccaaaaatcccttccaaatgatgttcctttgcagggtcccccacctctggcccagtccctgacagccacaggtctgttctctgtaacatccttcggcctggctcctttgacagacacaagaccatggaaattggcctctgtcatcgcagtactgggtccctgcagctggagggtgtggccttttcagtgatcctgtctctcctcttgtgttttgttttttttctgttgttgttgttttttttttttttttaggtttaaatgttatttgttctcaaaccagactttattataattttactttccagactttaatggaagcaaacccagccataacatttgaaaatacactacttagcttatctcgttttcaactgggagaattgccatgtttgacgatctgtcattacctaggtgacgatcttaaataattttgcattcatttcaacttcctgaaatgtgtttcatagaacctcccagggactgatattgttaaaataaaaaacagaacccacagaggaagtccatttccaaatttagaaaagattgcactcagcaaaattcacgaagcatctcatggcttctcctcctcgacctgacaactgttcttgtcaccgagtaggctcccctgccttccagaagagactgtcagccacatgcatgacaccggcatgtcttgaggggctgtggtctctcccctgctactgctcactgaagagttcgagtgttatgctctactggaaccccaaagcctgcatgtccctttctgctgtggcttctctcctttccttttaaagcaaatgcttatgtaatcccgcagtcactctgtgacaggtcctgataagcctttctcacgttaactcattaaatcctggtgaggccctcagagccaggcgttgctctgggcccccctgtgccaacagctccccaaggggctccgacagaaggacactggtattcatcatttgctgcagctcttagacaactctcccggcagggaagttctctgttcaggctaatgaaagtccctccttggctcttccatgccccacaaggcatcccaggccaccattcctaccgccctcaaagactctggggagaggagccagttacagagggaatccaggtccatccctttaaggagggcacatcccagactgtcccaggggagcctgtgcagtgccagagggcctgaagccagtgggcagagagagggctgctgcagtcggtggggaggaagtcaccccttctccagctccatgatgctgcctcacggtgaggatgcccacatcctgggcaccccctttgtctttctctgcccaccgcacaaacccagaggtgggagggaaactcatggtgaggtgaggtgctgtgactcaggagagctggagtgtggaccatgtccatccccaagtcctggcctttcctgttactctctatcatccagtgacctgagtgatgcttccaggagatggaagagtttcggggcaaaagcccagaccctagaagtccagatggtggccataagaatgtaggagcgaactggacttggtgaccacctgcagtcctgcacaggaaagccctggagggaggctcttggggaccctcttggggaccctctcggtgccctgttatgttgtgcatgtaggagacagtgtgagagagactggatgtgagtgtgtcagagtgtgtgcctgcatgagcgaggctgagtgtgtgcgtgagtgactgtgagggtgtgtgggtgtgagggtgcgtgagtcaggatgggtgtgtgaacacacagtgggcaggaacccacacttctgaatggattgtgagtgttttgggggctcctggtgccttgatcaggggtcaggatctctggctgtccccacctccacctggaagaaccagtcttcttcctgacacttttctgggcttctgagcctgggcttggcatcctctctgcagcctccgagcctgggcttggcgtcttctcttcagcctctgagcctgggcttggcgtattctctgcagcctctgaggctgggcttggcatcctctctgcagccttcgagcctatgcttggtgtcctctctgcagcccccgagcctgggcttggcgtcccctttgcagcctttgatccttggcttggtgtgctctctgtaggcagccacctagggggagcagcatggagcgagagtgggcagtgggcgccgactccatgccacgcctgctatgaaatgctgattctaagctgggaataaattccttgctagaagaacatgctgtgcaaggtggaaaaggaacaaatagaacctccccacgcctcccacatgcgtggggctctggcagggaaagagatgactgattgctgtcgcagaagcgcagatgcagggagcaacccgacccacacctccatggcatggcaggctaattcatgttcttcctcatgatttcttatgttgtgctacctccaaggagtcactgtaaacattcgctgtaggattactccgttccccccttcgttcctgtaacacatccaaacatgtaaaacaagtcatttgaaagttagactgataacatccagactggagtaggatacatccaacaattagcttagtctggttttataggcgtgtattcttgtgaaacaggtccgactgtgtttaccctttccgcagggaaaatctagtggagacgcggctggagttgaggcatttgcagttgaggctggatcatggtccactgtgctggctgagtcccccagccccacttccccaggtgatttggaaaccttgctgggcatgtttcagcagcaaatcaggcaagcctagtcccatgtctttgggttgacctggagacctgactgctgggaatgcccacagccctatctcaaagagcgtgctccgctcccaggccctactggccccttcttggcttcagctgagttggtcaagagtggatgggctcccaaccccagagaaactcatgcggctgcctgagaaacacactgacacgcagagggctgaacaggaagggaaggactgggctggtcgtcttcctggttgtgataactgactgggttggagcaaaagttaaagctgcaacatggtcagcaggtgaaacaggagtcgtgagagatccaaggctggtcagatttgtgtgagtgggaagattcagtgagctagagaaagcactaagccagcgcagtggaggaccagagagaaaactgctgtctttgtcagctgggctgctatggcaaaataccacagactgggtggcttacacaacaggaatttatttctggaagtccaggattgaggttctggctgattcagttcctgatgagagatgtcttcctgccttgtaggtgactgccctcttgccctgtcctcatatgatggagaaagagagagcgctctggagtctcttcttacgaaggcactcattttgtcatggcctcatttaaagctaatcacctccccaaagccccatctcctaataccatcatactgggggttagggcttcaacacaagaattggcggggagacaaacattcagtccataccagcagatacgggagacctgatctatggcacaggcctcctctagttcattccacgatgctttgcaccgacgggatacccagttcagggttgccaaggcctgtccgaaccacatgtcagggtctcgggcattaggaagttctgtcacctcctaatttattactccgatgacaggaaactccaccctctaactttcgagtcttaggagagtctctgtcccttgataaggggggcgggggggtgggggtaaggaagaatccaggccaggcatggtggctcacacctatgatcccagcactttgggaggctgaggcgggtggatcacttgagatcaggagttcaagacttagcctggccaacatggtgaaaccccatctctaccaaaaaaatacaaaaaaaaaaaaaaaaaaaaaattagccgggcatggtggcatgtgcctataatcccagctactcaagaggctgaggcaggcaaatcacttgaacccaggaggcagaggttgcagtgagctgagattatgccactgcactccaccttgggcgacagagcaacactccatctcaaaaaaaaaaaaaaaaaaaaaagaaaagagaaactctcagttaagtaagtcagtcttctgccaagtaagtttttattttctttttctttttttcttctttaaataataaagatggggtcttgctatgttgcccaggctagtctcaaaggcctggcctcaaatgatcctgccacctctgcctcccaaagtgctagaattacagatgtgagccaccacacctggccccaagtaggtttttaaaatgcagatggtacagggtccagatgagaaccctagggcctgtccactgctctggttggagcattcaaccagctacgtccctctctgctccagtggccctcaccctcactcacctaccagcagcctatgaaagattggtattaactattagatgaaatccagttctattcaaagtttttagagctttgtaaagggcctactgtgtgcagggtaccatgtggggtcccctggaggatgcgtgaatgatggagacacgatgccaaccttccatcaggagaagcacagaaagaatttagccaagaagccagcagggtggagggatgccaggaggaccctgaaggccctgctaaggattaaggcaattatattttacattcctccaaccggagactctggaagtagacgaagtgagcccctgcagtgcatagtgactttcctccaaagagcacagcataggaacggggagggcaaagagcaacactgccatgggaagacctgaccatcgccgcctgtcacatggtcaaggtcaagcgttagtcgggttgacgaggtgtgcccttgctgtgatgcaatacacgtggagctttgcctctgtggtcttccccactaaaactcacagccttcatctcaccgtgagaaaaaaaaatcaggcaaattctgatagaggagcatcctacaatatccctcatcagtcctcctgaaaaccaccaagatcatccaaaaccccgagtcagaaactgtcacagcaagaggggtctaaagacacatgatgactagatgtcacgtgagaccctggatgggatcctggaacagaaaatggatattaggtaaaaacgaaggaaatccgaataatctagggactttagttcctaataatacgtcggtattggttcgctaattataacaaaattactatactaatgttaggtattaataataggggcatggcatatgggaactctgaactatatgctcaatatatctgtaaatctaaaactattttttttgaagagcatcttttttttttttttttttttaaccctgcagcaatgagctttgggatggacagcctgtgaaccagactctccctctctccaggaaatttggtgagctattcagcatctttttaatctctttcttgcttaaactagctgcagtgagagctctgttgtctgcaaccaagaatctagactaatacctgcatttagttatttacatacagtgtttaaaaaagagagagctgcaggagatttggtgtcattttccattttgagctgcgatcatttttaaaatgcaggataatgtctgcaaagtacctggggatagagtcaggactaatgagataatatctgcaaaatgctttgagttccctggagctgctgagaggcaaggaacatgcattatcatcattagaaaaaacaagctttgaaaactttggcaggaaggcggatataagtggaaatcagttcaattactcatgcctttcaaaatagacaagttctataaaagttaaagtattttttttttttgtaaatcaaattcctcttcatttcctctgtcaaacattactgttctatgatctttcaattatttttggttggactccctttgacaatgtattgaagcagctttcgtttctctgcttccagattctctggcagaatattctcaaacttcaaatctatctccattttgagaaaatatacaaagcatatgctttcttttaatgttacttgaaatttcaaaacaacatggtgaccaaaactaaaccaatacaatgataggaatagaagaaaatattatttttatttttcaaattttttattttatttatttacttacctatttattttttgagacagggtcttgctctgttgcccaggctggaaggcagtggcacgatcacggccacagcctcccaagtagctggggctacaggtgtgccccaccgtaattggctaatgttttatttatttttgttttttgtagggagggcatctccctaggttgtctagactggtctcaaactcctgggctcaagcgattctcctgcctcagcctcccaaagtgctggaatttacaggcgtgaagccaccacactcggccatctttaaagatacattaaaaaaatttgtcagtttatatatgagtaagcttggagtcttgcattggcatcttctgaagaagagggagaacagagctcatcatgaccctttcaacatctagcctaacgcactgttttgttttcaaagtccgtaggaaggaaaaatcaaatatagacgggtaaaaatagaaaaatgataagaatgctttctctcgttttaaggagggagattttacctagcaattctccaaagttcttgtatcagttaagactttgttgtgattaacagggattatcatctcccattctacttgggttacctgtgacccaagctgtttttcttctaaaaccttacagaagatcacaagaattagccaacacattctaaacatttcctaaaacatcccctcaaactatcataatggataaatgacctatttcttaagatataattgaagacaatttaattaactattttgcaaacatgtaataagaattcctcgtttcaaaactgggctagaggtatcctcactgttctctgggcaatttagcttgttagtgtttatgatttgcaacacttacctcctggcaccaaattcagatttagcaaagattctttatgtggcaagtaattagaaacccaacttaaactgtcttagatgacaaaggagattcattggttcccattatagaagtccagaggtgggcagatttccgggcaggttgatgcaatgactcagttatgtaatctaggaagcccgtctgtcctttttctgttccttttgtagacacagttttatctagggacccatttcctttatagacttgtaaatgtcaaagccaagccgggtacagtggctcacgcctgtaatcttagcactttgggaggccaaggcgggtggattacctgaggtcagtggttcgagaccagcctggccaacatggtgaaaccttgtctctactaaaaatgcaaaaattagccaggcatggtgatgcacgcctgtaatcccagctactcgggaggctgagtcaggagaatcacttgaacccgggaggtggagcttgcagtgagccaagactgcgccactgcactctagcctgggcgacagaatgagacttggtctcaaaaaaaagaaagaaattcttggtggtgtttcctggtacagatagaatattaggaggaaagaggatttcttgataagctctgaaataggatttttcagccatgatatctagaaaatagtcccccaattcagcctaagcatgcactaggtaaaagtttatttttctgtgaaattatcttaagaacattgtgtttgaaagttttatgttgaaacaaataaatagaccattttagtaatgattcctgacatctgtgacttgatttgagctctaaatgttttaataaggcaaagttcatattcaaacttttgaacatagttgtctaatatgataagctttgctggaagatcttttgaggagtttcttttctctagtattccaaacataggatacctgtctcaaccagcaggtaaaaatgcttattttcctttgacaaccaataaactccagtacccagtggagcagcactttctgattggcattcagatcttcatccagagcaaagcaaaacatctgggggttgacacacagtttttcatttcattgattatctttagttgaagttttcttatcgatttctggacagagttttgaaaggtaccactgatggtccatgacagagcacacaccagaaatgagtgtttttcctttgattttcactcagtatcagcaaaccccagttcatctggagcactagcatggcaaaaccccattaagaatgtttttttttttttttttgctatttagcaaacttgcttagaagaattttcatgcagtgttaaaaattttcatgcagtgttaaaaatatcataagggactgggtgcagtggctcatgcctgtaatcctagcactttgggaggctgacgcaggtggattatctgagctcaggggtttgagatcagtctgggcaacacagtgaaaccccgtgtctaccaaaatacaaaaaaaaaaaaaaaaccaaaaaacaacaacaaaaaaaactagccaggagtggtggcgtgcgcctttagtcccagctacttgggagactgaggcatgagaattgcttgaaccgggaggtgaaggttgcagggatctgagatcgagccactgcgttccagcctgggtgacagagagactctctctctctctctgtctctctctctctctctctctctgtctctctctctctctctctgtctctctctctctctctctctctctgtgtatatatatataaaggttttatgatgatctccaaggtcccagaaaccacaattcttttccaacagaatctcgagtcattgtgcctagacgaatgaccatactcaatttcctttgttatcgtaacagggacaagagaggtgttatatcaatcttttgcaaaacttgaagtttcacatcctaagctaattcagctaatcatttttcaattgaaaaatgggactggcttaaacagcaatctgaaacattctgtcagattcctctccaaagaaaactttggcagctgtcagaatgcaaattgtcacacaagttccactgccatgataggttagcttttgttgttgttagtgttgttttaatcttgaggatgggaaaggctaattcatacagaatctacagcaccttgtccattcccaagagtgtggtcttgttctgtccaatcttctgtgctcctgaaaatgctcctttgctggaaaaacaaatgtataaacatataaaaattcttcttaaaatattttgactaaaatattatttaaatcaagaatttctggcataattacacaacatttttggaaatgtagcatactgaaagaaatgctccattcttttgcatgaatccatacatgacagtaaacattgtcaaaaattttgatgacatcttcaaccctccccacacaaagctctgtaaaaacgaaaggttttggcaaaaacacttggtcccacacttgtagaatgacaatattgtatcgacttgtacagataaaaaccagcccatcttcaagtttggttgctaggagcaggaaactctaatatgatgcaggaaatatatttgcttccgtggaaaattgtgcattttcttagtagctagaactccagggtatctgattttagcctttcgttgtctttgagctatttcatacctcaggaagttgtagataactgtgttagttacttagggctattgtaacacagcaccacaaattgggtaacttagcacaacagacattgatcacttcacagttccagacgttactggaactgaaggctccagttcagagcttactgagactgcaaccgacgtctcagcaagaccaagccctctctaaaggctctaggagaggttccttcccgccctcttcccagctcctggcagttgctgtcaatgcttggtgcttcttggtttgtagacgcatcattctgatttctgcctccatctttacattgccttctccactgtgtgtctgggtctctgtgtccgagttgccctcttcttataaagatatcagccatgttagacttacggtctactcttctccagtatgacctcacttaacattattatgtctgcaaagaccctatttccaaataaggtcacattcacaggttctgggtggacatgagttattggtggacactattcaacctagtacagtaactgatagcaatgagaaataattcttgtttatagatatgcaaattctgtcatgttcagaagaggttcaactgacttcttgcccagccaccttggaaaatcagttttgccttaatttgcacaatcatttccatattcctgatctagaaacacatctgctcttcagattatctttaaactggatggaacacctgccttgttccttcatttatggaagaaaatctttaataagcattcatttgtatatctgtaagggagtcatgattttttttgttttctttttttaaaattatctttaacagtgaaaaggggagaaaacaggaagcacaagggaattcccttccctcccatgggccagggccagtcctaagcaaagtgctgcagaagggcaaggctgtcctgagcaaccttgaccacctactcaataactgctccaggctgggtgtggcttcatgccagctctttgggaggtcgaggcaggaggatcccatgaggccaggagttccagaccagcctaggcagcacagtgaaaccttgtctctacaacaaataaaaaattagccaggtgtggtggtgcatgcctgtagtcccagctactagagaggctgaggtgggaggatcgcttgagcccaggaagtggaggctgcagtgagctatgattgtgccactgtacttcagcctgggccaaaaaaacaaaacgaaacaaaatgaacaaacatgctccaccctctcagttcatcttcttgggttctctgcacttcatctcaagtggtgggggtccttacttgaggcctgagtcaaagactttctcctgaatctaacccaccttcctgcatccatatgctcaccatccccagtggctcctatgcgagccacagttgggagatatctgaccccttttttccaccaaactcccccaccatgctgctgctgacccaatttcaccactgctcagtgtgatttctagtaatgaataataattagactctgagcctgctttccccagtttcatcctgtgctgcctctgaactcacgtgatatcaaaaccttttttttttcttaaacaattgattcctctggcatagcaacaaacagatagctagaaagtcagctctgtaaattgagaaacttttcagataaatcattatttgtatttttttattgctttttttttctcatttgcctctttagtaggtgatttggcgtaagttttcaaaagcctttcaaagctatatggagccaggtatggtggcttgcacctgcagtcccagctactcaggaagccaaggcaagaggattgcttgagcccaggagtttgaggccaacctgggcaacataatgatacccagtctctaaaacaaacaaacaaaaagtacaggaacaacaaaggtatacaagaaaacttttggaggtgacgggtaggtttattacctcagttgtggtaacatgaggctgtttatatggcccagctcaccaaattgtatatagtaattaggtacagttttttcatatgccaattatgcatcaataaagctggaaaaaacatataaataattccacttatagaaataattataagcatataaaagacagttgagccaagatagatacacacggcggtgcattgcgcttttgtttacaacagtgaccactggaaagaagccaggggcccatcaccattggattgtttgaatgaatgatggcatgtcaatgccattcagtgctacacagccacgaagaaggccgcagatttgtgttgttagcatgtaagttggcatgtgttagcgtgtgtgttggcatgtgttagtgcatgtgttagtgcgcgtgtcggcacgcgttagcgtgcgtgtcggcgtgttagcgtgcgtgtcggcatgtgttagcgtgcgtgtcggcatgttagcgtgtgtgtcggcatgtgttagtgcgtgtgtcggcatgttagcatgtgtgtcggcatgtgttagcgtgtgcgttggcatgtgttagtgcatgtcggcatgtgttagcatgtgtgtcggcatgtgttagcatgtgtgtcggcatgtgttagcatgtgtgtcggcatgtgttagtgcatgttggcatgtgttagcatgtgtgttggcatgtgttagtgtgcgtgtcggcatgtgttagcgcgtgtgtcggcatgttagcatgtgtgtcagcatgtgttagcacacgtgtcggcatgtgttagcacgcgtgtcagcatgtgttagcgtgcgtgtcggcatgtgttggtgtgcgtgtcggcatgtgttggtgtgcgtgtcggcatgtgttggtgtgcgtgtcagcatgttagcatgtgtctgcgttagcgtgcgtgtcggcatgtgttagcacatgtgttggcatgtgttagtgtgcgtgtcggcatgtgttggtgtgcgtgtcggcatgtgttggtgtgcgtgtcggcatgtgttagtgtgcgtgttggcatgtgttagcgtgcgtgtcggcatgtgttggtgtgcgtgtcggcatgtgttagcacgtgtcggcatgttagtgtgcgtgtcggcatgtgttggtgtgcgtgtcggcatgttagcatgtgtgtcggcatgtgttagcgtgcgtgtcggcatgtgttggtgtgcgtgtcggcatgttagcctgtgtgtcggcatgtgttagtgcatgtcggcatgtgttagtgcatgtcggcatgtgttagcatgtgtgttggtttgctagggctgccataaccaagtcacagaaaccaggtatcttacaacaacagaagtgaatggtctcatgatcctaaaagctagaagtttgaaatcaaggcatctgcaggacaatgtaggggagactccttcctgcctcctccagcctctggtggctctcagcaatccttggcattcattagctttaagcggcatcacctcaacctctgcctctatcttcacaggttcacacggccttctctctgtgtgtctctctcctcttcttttcttttttttgagatggagtttcgctcttgttgcccagtctggagtgcaatggcacaatctcggctcactgcaacctctgcctcccgggttcaagcaattctcctgcctcagcctcccaaagtagctgggattacaggcacctgtcaccacacctgcctaattttgtatttttagtagaggcagagtttcaccatgttggtcaggctggtctggaactcctgacctcagatgatccacccgcctcggcctctcaaagtgctgggattacaggtgtaagccactgcgccccgccttgcttcgggtggtttttctaacttcagggctgggaagcagccactctggtgggaaagattatacctgcccataggagagactggtaggagatggagaaaccttccagaagggggagaagtcaatggattttccaggtgttatagtggaagaagctggcaactccagatcaggcctgtggttgtagaaatctgtaaggttctggaaatgcttccatgtttgttatttttatgctcctgtcctgggccacaaggaaagaaggcagtcagatcggaggtgactgtgtcctactacacaactggagaagggctgaggtgtggctgcgggaaggaggaatgtgctggaggaaaaggaccccacagctgctgagaggctggactgctgccctgggctcggggcgggggccccaaggtgattctccagtaccttacttttcgacacctgaagcattggaggtgtggacacgacattgatgacctctccgcctaagcccttcaccgtctttctctgctgccatttttaatcttccagaattgcacccagtttttaagtggctggtacccttgccaagctgcccttggtttctccagtttgtcttctgaactctagtatgactggaggctgcttggagcagggaggaccaccgcacagccccaggacagttcaattagagaagcaatgtgctgtgttctaccagcaacagcaggaatgccaatcctaatgcttatgcaatgcttcttatgtgccaggcgctgttttaagaattttacataaattagctcatttaatcctcaccaaaatactatgagaaaggctctattctcactcccatctttatagataggaaaatagaagcataaaggggttagacagtagctgaaagactgttccacttgtcaagagaagctgatgcatttcctgagcctagggtgttataatgtcccccagaaaaagcccatccgaaggccagggtttttgtttgagacagagtttcactcttaccgcccaaagctggagtgcagtggtatgatctgggctcactgcaacctctgcctcctgggttcaagtgattctcctgcctcagcttcccaagcagctgggattacaggtccttgccaccacacctggctaatttttgtatttttagtagagacggggttttaccattttggcaagcctggtctcaaactcctgacctcaggtgatctgcctgccttggcctcccaaagtgatgggattacaggcgtgggctatagcgcccggccagaaaaccagtgtttattgttggtcttgtgggctgggagctaatgagcacattcttcaatatcagtggcactctctgggttaaacgtgcagcaataggtcagaggacacccggggtgggcattcccaaccagtgatctggccctggggaatttggggtaaacaatgatttgaatcgtagttaagctcaagagccaacaagaaatgcctaaactgtgagtagtgctacagaggatcctgaaatccaatgggctgcttggaatcccctccctgaggacgcctggaactgggagggagccttcctccctaggaattccattctcagtgggaggccacagggcgtggagcactagcactgaggtggttcccagggcacctcttacaggacaggggctacaggaatcaagagaatttctgggatagggagagagctggggcagtgggtttagcttccttctgcatttactaagggctaattaataatcataactaatattgagtgcttgctcagtttcaggctccacactagatgcttctcatgcgttgcctttctctgtcttccattaccacttcgtgaggcaggtgttgtattcctggacagggatacataacttacccaagctaaaaagagctgagtttttaaaaaagggccgggcatggtggctcatgcctataatcccagcactttgggaggcccaagcaggaggactctgtacaaaaaacaaaaaaacaaacaaacaaacttattgaagggttgcaaacattcagaaaaatcttaagtatatagattgatgaaattatgttaaagtgaacccattgggacaacagataggacattcccagtgcccccaaaacctcccttgtccacttcccaatcactaccccttcttcctcccaaaaggtagacactatcctgatttccagcactagccattagtttagcctgatttctaagcttctgtcaatggaatcatacagcatgtgctcttctgtgtttggtttcttttggtcaacgctaagcgggtgacattcctttatgctgttgtgtgcagctcacccgttctcactgctgtgcggtgctgcactgatgattgtgccgcaactactctatccaatctactgttggggagcatttgtttcctctctttcttttttgccacggtgaaaaaagtttccgtgaacattcccgttcacgtctttgtttggccacatgtacacatttctgctgggtacgtgcccaggagtggaatgactgagtcacagggttggtgccaggtggggttttgagcctagacatgcctgctctaaactcaagagcggtgccatgccatagatcactgtgtggatgtggaggcctacagaggagacacctgaggtggcagtgggaatggagggggagggatgagaagcaggagctgcagagggaggcctcctgggcagatggcagtgctgtgttagtcaggcttgggggagtctctaggtgcctgtgtgacccccaggaggcactatccagggtgccgtctggctatgcctctttaagcttgatgggaaccctgggtgtgagggggccagccagggctgaaggtaaggtgcctggggagggaggggacagagacaagccttgtgccttgggccctcaaccctcgccactggagagtgatgttgcctgctcagaccaagtggggtgggactgagagaaagtggtgactgtttataaagcaaggccaagtgcaagaactgctgagtgactgggaacttcctgtgtgcagaccacacctgctttttttttttttttttttgagagtcttgctccgttgcccaggctggagtgcagtggcacgatcttggctcagatcctgggttcaagcaattctcctgcctcagtctcccaagtagctgggattataggcatgcaggcatgcaccaccatgcctggccaatttttgtatttttagtagagacagggtttcgccatgttggccaggctggtctcaaactcctgacctcaagtgatccacccgccttggtctcccaaagtgctgggatgacaggcgtgagccaccatgcccggccgacacccgcatttttaagtagccttctttttcagcagtgtgacttttgcggggcaatactcagcaaccaggatgatgtggagcttccggaagccaagggcaggccaggagacagtttgataagaggggcattcacgtgagactgcctagtgacctgaggcaggaaaggagacaaactgcaagagcagggttgtggtgctgggtggtgaaaagggttgagccattgccccaaagggtgtcagaaagtgaagcattggagaatcaccttggggccgccgccccgagcccagggcagtggtccagcctctcagcagctgcggggtttagggcacagcctcaaacctttaggggcaatctgggtagtgaaaagggttgagatatttaggggcaagtcctagggcaaggtcaaaggaggtgcggaggtcaggagagaggccaggtggaaagctccctaagccacctgaaatatccacagctagaataaaacaaggcagccttttcccaatacacagaaaaatgctggctctagaattcggccagctccattttcagtgtcttttacaccaacattttaactttaccttcagtgccttttactgcttagtggcaaatgttcctagatgaccatgggaatcaatgagcagaaagcactgtattgatgactggaaatccttactgagagacacactcatcttcactggagagcttgtgtatgtatatgcatgtgtatgagtgtgtgtgtgtgtgtgtgtgtgcatgcaggtgtgctgggtggagggtggggggcacttgttgtgatttcatattgtgccaataaaagcagattttacgctggtgagagtgatctcagttcatggggtggacgtatgtgtaatggacggtggtccccctgcggccctctgattgtgcagtgatatctgggaagtctgagaaccgcatcagtgtggggtggactggataggacgagaggctggggacggtgggaaggtgcaagaggaagaagcagtggaaaggagctgccaggtgttggagacagtgtgagggaagtgaggaagcggccccaatagagggcccaaagcaagggtccctagagtgctggagtggggaaaaggaagggcattcagttgtagatatcattagggcttaggaaaaaaagacttaaaaaatacactgatggagttcagacaccttcttcaaagggtggatgatctgaaactaagggagaggtgagatttggttccattcttctgacaacctggggaagggcaaattgggccccagaatctggaactcaaagacagacagtagagattgagttgaggtgcagtgaaaaatcatatgtaagagagaaaaagaggctgggctcagtggctcacacctgtaatctcagcacttttggaggctgaggtgggcggatcacctgaggtcaggagttcgagaccagtctggccaacatggtgaaaccccgtctctactaaaaatacaaaaattaactggggtaggtggcgggcacctgtaatcccagatacttgagaggctgaggcagaagaatcgcttgaacctgggaggcggaggttgcagtgagctgagattgcgccactgcactccagcctggtcaataagagcaaaattctgtctcaaaaacaacaacaacaacaacaaaaaccaaataaataaataaataaataaataaagagagagagagagagaattcttatatgaagtcaaaaccggctgtgctgctctgtcctctgaggcatgcgtgtatgtgtgtctggtctattcccctcaacagactatactttctgctccaccacctaaacttgagagttttattgaggtcctgttcttttcggtgacatcccacctcttcagcaacaccttcccgcccttccagtttgagtgctcggtagctgcacatcctgtgaacaggttgcacacacaggaatctcaacattatgaataactgcaagcaggatgacaccgggatcctcttctctccctcccaatgcctgcagtggatatctggactacatatgtaagtaatacatcaaactgagtaaatactattgaggaaaatgtttacaagggatgggaggggaagtctatgccaacaaagagaccagaagccacaagccccgaggcatcctggcaggtctgctgcggggcctgggagccggctgctgacacagggaatgtgggcatgagtcaccggtgggggcttctgaggaggaaaaccatgacaaagtgtgcatattgagaagtggagtgtgcatctgccgtgctcagtaagccagttgactgaataactccagattaggagagagaatagaacttgggaatttttatcattataaacttggggtatttttggttctaaaaatgaaataccaaaatgttctggtgaattgtctgagagagtctaaaccctatatacatatacagccatggaaacagaggcagtcgtactcaagtgcaaaaaaaagtgtgctagtgaaaagtagtaatgggccaggtgcagtggcttgcacctgtaatcccagcactgtgggaggacacagcaggaggatggcttgagcccaggagttcaaaaccagcctgggcaatatagcatagggagaccctatctctacaaaaaataaaaaattagccgggcatggtgatgcatgcctgtggtcccagctacttgggaggctgaggtgggaggattgcttgagtccaggagttggaggctgcagtgagttatgatttgccactgcatcccattctgggtgatagagtaagaccttgtctcaaagaaaaagaaaaaaaaaaagaaagaaagaaaaggaagaaaattagtaaccatcagctccagctccattgcagtccacgtcttaggagcgtggattttgttcccacacactttgtgccagggttgagctgagctttggcactgctaagcatgtcgcttctgggttaggtaggtggagtaggttgctttaggtttagggtcacaggagagctgggctggctcagccatccctccttcacttagtcatcagaaatgtttcccaggcactcaagccacgtgctgctttagcatacaacagggaacagtctctgtcctagagaattcagtcctcagccttgcccctctgcaaggctatgagcagaactccaggctactctcccttcctgtggtctcaggactgccaggggcatggagtatggggatccccactttccagctctgtttacagtgcttggatgaccatagtatggacagctgaagggaatccaggggactgtgtctgtatttcctggagatgatcactgttcaggcaaagcatggggcacatgtcgtcatcaaatatggcttagggctggaaatgtccactgaatttcataggaaagaaacccttgtgggatccttggggaagccagggatggtgggggtgggtggggcaggagcagatggcagcaattcaaagagcagcaggaggaaatgaaagtaaagacattaccttctttaaaaaatgtttattttattttactttttgagacagggtcttgctctgttactgaggttggagtgcagaactgtgatcatagttcactatagcctcaatttctcaggttcaagccatcctcttgcctcagcctcccaagtagctgggatgacaggcacagccaccatgcccggctgacactgccttcttactgtgtagagcataatgtttggggggtttttcccaagaagcgtgaattacttttgtaattttcgattgtgtgtattacatatgtcaaatgaagaaatggaagatgaaaaagtgcagcttgtgcggatctgtcttgcagaaggttcagctgtgagctaagctggtgggggtagcgcaggagcgtgtgggggcgtaaagtctgttgtggagtggggatctgagtgggctgtggatgcagaaacagatgctacaccatgacgggaggacctcagggagggttgggagggatccagagtcccagggaaggagggctcagggttctgctgcaggggagggtcctcttctgtgttccccaagatcagaatgacaaagtcagggatgctgatggctgagcctcccaacatgcagtcgctgcccagcctgcattctccctgccttcatctttgtccccatgggcacgttttgacctgaaactgacctaagagagaataagctgagtgacaagggaagccaaactgtgtgattcaccacggtagtttgaaatcctgatttaggctttgctttgctgactgaatttatgctcagttagggagaggatggggtggcaacttgtaggcctggcattaagcacactggtcccagctgagagccaggcacgatgcccccatccctcctggttcataaggtgctggtctatcagctccagtccccttgcttggtgtccctgaagtctcagtctggcagttttacacgtgctaaggcatgaatccggctttacagagggctgttgatcctcagaagctgacacagaatctgagtatcctcctgagtcccatatttacctacctatggcaggaggttttttaaaaaatcctgaagatacaaagactttgaagtgtaagtggctaaagaaagctcaggttcctggtgatcagctgctctgtgctgaccttgtgtacattcagaagtttccaagatgcagcagagctgggtctagcaggcatcgccttctcttttgtttaacacatctgttgaagatcaaccaagatggtgaggcatccttttagatgctggggattcaaaaagaaattaacgagacctggttcctgctcttggcaaactgtcagcttacagaggaacatagttttgcaaaaacatattggaaagcagggcagtaagagtgattacaggggcatgtaacaggggaagtgatagggaaaagggtggagtttctcctgcacttcggggaaggccatcagggtgggtcatggggaagccctcgattagtaggtcattttttttttttttttgagatggagtcttgctctgttgcccaggctgggctacagtggcgcgatctcgggtcactacaacctccacctcctgggttcaagcaattctcctgcctcagcctcccgagtagctgggattacaggcacgtgccaccacgcccggctaatttttgtatttttagtagagatggggtttcaccatgttagccaggctggtctcaaacttctgacctcatgatatgcccacctcagtctcccaaagtgctgggattacaggcgtgagccaccgcgcctggccgatcagtaggtcttttaataggttctcacctcacaggactccctcaactggccttgtaaatccaaccacatttattctgttgaataaaaggttccattggcaaaagacccaaggccttttgtccttagagtaggcatggattttctagtgataccccactattgctaatcccatgcagagcaggaaaaaggtggcagaactggcagttaagtgcacacatgcatttacttctagacatttaatcacaaagaaaacttccttaaaagaagctgaagttccgaaatggttacatgaattgagattgtaataggagggatctaggtgctgtcaattgaatggagtgaggcccaaacagcaactaatctctttaatagggagatccagaaatacacagagacctttctttatattcctaaactgatgagaaaggtaatctggcctagtgattccacagattgacttcaggacactctaggttgctcccacgagtgtgggaatcaactcagagaaatttgcaaaaactccaaaacaaatcattttggtttttaaaaacatgagtgttttaaaactgttttttaaaaaatgagtgactaagagatgtcccgttccccactcacttcttctctcgtaggcagtgggagagctggaagagcctgttacaaacctcagcccattagcatctcccagctctgtcttttgagaagatgactgagaggaaggtggtattgagaaaacaaagcatccagcctttgtgaagctgagccttaaggtcccctctccagccctggctgaccccagaccctcgttttcttctctggcatccaacttcaaggattggcctgtttccctttaactatagctaccactcagctcactcgctgaagaaggcagagcccacgcctcctggcacagtttcccttcggctacctaaggcaagcgaatgagtctttttcatcgtaatgagctgtatttccctcactatggaacaacaggggctaaacaaattaataaatatgctcagcttttccttcttggtttgtgaattctctctacgttttggctatcatcctaaccacttgccacaagcagcacaattaatgttttttctgcaattaatgttttttccccatttagcttgctctttctttcttttctttcttttctctctctctctctctctttctgtgctgggattacaggcatgaaccaccgcgcccggtcgagtttttttcttaatatgctgttttgctgaactgagttttagttcctagtaacagagactaactctggaaagctttcgtcaacgacaatgaaaacaacagcagcaaaagaaattatcagacggttgttatctcatgagatctactttggattagtgctgtcatgttcccctccaagcattcacacaggaatgtggtcatgtcatttctagaacagtatgaagacaagtaggatctttacagccctgagtcttcccatctgagcttgaggtctggctctcccagtctctctcactgagaacaatttttacacataatactggggtttaaaaagctcaagccacttgaggtgggatgtttttctgaggaaatacctggacaagggtgcatttgtgtccactaaggaaaatgttggaaataccctaaacatcaagaataggagattggtacccccacagtaacagacattcaaaatctagaactattatcattgtaacttagcagtggtaaagccataattggaagccagcctgtctgatatcactatctggtcttcaccccaagctgcactgccttctatacacatttctcattcacttcacctgggctagctctctcggcaaataaggcaatgaatctggagaagcaggtcctacagaacaatttatatcaaggcgaatggatactttaattttcatactaatgaaagttaacactgttgctaaattccagacaatgtgagaaggttttaaatcactctctccttcagttcttcatttagccttgggagatgggaactggttattttattttcttctttggtgagggatggcgtctcactctgtcatccaggctggagtacagtggcacaatctcagctcactgcaacctccgcctcccaggttcaagcaattctcctgccttagcctcccgagcagtggggaatataggcatgcagcaccatatctggctaatttttgtatttttagtagagatggggtttcaccatgttggccagattggtctcgaactcctgacctcaagtgatctgcccaccttggcctcccaaagtgctggagctagttattttatgaacactgtggtgcacttgtgtgctcctccaccactaggttccccctgcctccctccttccaaaccaaggtggggcaggccctataggtgcatgcagttttctctctcttcaagataaacatactgcttgtaattttgaaaggcatgttacagacatataactgagctagtgctgaatttttaaaaaatggtccaaagacaaattattcaactaaatgaacaaattgtgtaattgctatgtatatctttcaaaatcataacaaaataattcattgaaacttgacagtcggataaaatataatttctcagtacttctctttttgttttgagacagggtctcactctgttgcccaggctggaatgcagtggcaccatcagggctcactgcagcctcgacttccccctcaagtagctgggactgcaggcacacgccaccacactaggctatattttgtatgttttgcagagatggggtttcaccacgttgcccaggttgggcttgaactcctggggctcaagggatccgctagactcaacctcccaaagttttgaaattacaggtgtgagccaccacacctggcctcagaatattaatttaagttatcctgagtcggcagttttgataagctactttctcctacctatgcagattttgtacatataataaatgttggctttactaaaaatgcctatgcctgattttgtgtctttttttttttttttggtgttttgttttgttttgtttttgagacggggtctcgctctgtcgcccaggctggagtgcagtggcacaatctctgctcactgcaagctccgcctcccgggttcacgccattctccagcctcagcctccccagtagctggggctacaggcgcccgccactgcgcccagctaattttgtttttgtatttttggtagagacagggtttcaccatgttagccaggatggtctcgatctcctgacctcgtgatccgcccgcctcggactcccaaaatgctgggattacaggcgtgagccaccgcgcccggtcgattttgtgtttcttttagcccatcttccagaaatgtccagactctactgtctttgttgtaaaagaagcatattttattttttatttattgtttcttcttagcggtttatttttaaaagacaggaaaatgatcagcttgcatcctgaatcggaccacttacttataaacgatagttcttctttgaagcagacgatgacattttagtttatatttaaggggaaacacattcaaatgctatttggactcaaatttctaaggaagaaaaggaagtggtaaactctgaagatagaacctcaattcccttgctgagtgacgcggtcaatgagcaccaatcgcctacgggaggccagaaaaggctgcgtggtgctcccctctcagggcctggccctgtccacctgggccttggtgacccgcagccgggactcttgctgtaaagtgacgcagtgctctccctgggaggacagtgggtccagcaaacccaactcagccctcagggggcacttgaaattgtaactaccccaggcctttggaaacaaccctcaaccttgaaaggggaaattcccagtgggaattgatgcaaactgtggtcagttacacaaaaaggtagagtttactgtaatctgggggctatttttggttgcagaaagaatccccggagtagagaaggaggccagcgagtctcagttcgctgctcgctcagagccgcccaggtgcgagggcgtcttcaccagaaatcggtgctcccgcgcgccccaccctccggggccctgcagatgccgggtcgggggccgccagcaggccctttggctcctgctggagacactggaagaccaggcgaccaggacagcgggtcgggccagtgcggtgtgacacgagggctcgagcggcttcgcagtttaaacgtgtcctcatcctacacctcccacggctgtttcggattcggtgccctcgtgcccctcagcttgcccagcggcacgtgggcctcaagcctggtccccagcggctgcgccagcctagctgtgttcaccttggggccgcgagggcctcccaccggctggcagctggtggacacgctgtcaagatcgggggaaaaaaaggaaggaaggaggctagggggacacagggctggtggcctccgcagtctttgacctgcgacgggcgcgagcgcacctccgcgcctttgcgcagagaccttcccccaagattggctcacgacgcctcctaccccgaagtcaagggctccctgtggcaaatcctcacacgccctcctcctccccgcccatccccggcgccaggactgacggggagagggcaaggccgggccagaggggctgtgggcctggactgcggctgtcgcccgcggccctgctcttttgggcagccagacgtggggtcagcgcccagtcgcagcctccgggggtgagtccgcagatccccgcacgtgacacaggccaggcatggggacggggagttcctcgtcgtccgttcccactcagatgctccctgaggttccggaacaccccgccccccatcccaggatctgaccaaccctcaagccacggccggccccggttccgcgagacgggggactctgaggattgtcctcccttccgggctgggactcccccacagcagccgaccgcccccagttcagagtggcccggcccgcagcgctccccgggcacaggtcccaggtggacggctccgctcccgcgcccggctcctctgcccgccaagcgccccggggattccccggcctccaagcggccgcggccgggtggagtcagccccgaagcccgggatcccccgaagggagaaaacccgctctgctcctctgaagcggcgggagaaaccggccccacccaggtccgggggcccgacgccctcggcggaggccggctccaggggtccgaggttcccgaagctggaggccggctccgccccggcgtccccccgccgccacctccgcccccatcccgcgggccggcggagggaggggcggggccgcttgccgcccgcgactcgggttcggcttctttagtgattgcttctgcttctcccgcgccagctgtccccagctctggggcaacgctgccaggtgcccagtccccgcgctcgagagagcgcctgcctggctctgaactctggccaggaaggggcgcgaggggaaggccccgggggaaggcgtgtccccgcgccccgccccgccccgcctcggaaagcccccgcggtcccgcccaccccaggggctcgctcagcctccggagacttttttctttgagcgcagccgcctggtgccggtttccgccgagctggagcgcgcgggccacggcttctctggggacgcagaagcgagaagcggggacctcggcgcgcgccccgcgtcccgctcttcctgcccgcgccccggcccccggcccgcgccccggccgccggcatggtgctgctggccgggaccgggccggagggcggcggggcgcgctgcatgaccccaccaccgccgtccccaccccggggcgcgcaggtcgaggaggaccccgctgactacgaagagtttgaggacttctcgagtctgccagacacccgcagcatcgcctcggacgactctttctaccctttcgaggacgaggaggagcacggcgtcgagagcgcggagagcgtcccggagggcgtcccggaaagcgtcccggagacggcgaccctcctgcgcgccgcctgcgccaacaacgtggggctgctgcggacgctggtgcggcgcggggtgagcgtcgaggaggcgcaggagactgaccgcaacggcagggtaagcgggcgtccccgcaggatttgagccccctcactgcccccactcccctcctccccaccacatccccgcgcctcccagctcctggctccggaccggtccctcggtcactcagccgccgcccagagcgccttttccccgctgtttgggagcgcggtgccctgggtggcttccccgtctcaggctgggggacgcggtgcggggagggagcagtcgaggtgtcagcgcggcagaaacgccagtccggcgtcctcaccgcatccccttctcgtttaccggtccccgtggacctcctgactgaattcgcgctggctgcccgtgctgcaatccaggatgggcttcttgcggcccggtcccctcctgactattacctttccccaggtccctggcaggggaccattcctcctcccctgcaggagacagcccctcctgcccagcgccccatttggcccctgggcccctcgcgccgcccttgtcctaacacgctggggcgcagatcggctcctccagccgcaatgatttggaagcaacagtttcttccctcgccgggacagcttggtcccctaccccacctccgctgagctttgtggcccgcgccgcgaccagccaacgtgatctctgactggtctgtccgcaggtcaccttcgcgagccaatgccagccggggctccccagagtcagggcatagggagagccccagagccgcgggcatccacccgggtagggcaggaggcgtggaggcaggcacaggctatcctttcgttatgaccagattcagagaaaacgagatgtttagaaaagaaaagaaaagaaaggaaaagaaaaaaagttggcttaagaagacctgagaaggactggctggtggaacaccttccaccaagcaaagcacttcaagggaaaactgcagagtgaccacggtggccaagttccccgtagtctgtgctcagtgggcaaatggcagcgttctcacctgatttttgtattgtccaaggaccgtggtatctgcagatgcagcctagcacaaatgcacatgctttttgctcaggagcctgcagctgacagaaaacatgtgctttgacttggggacccgggtgaccttgtgcctttggtttatcctgcagtgggtggggcaagtggtttgccctgactgtggtttgggctgggcttaggtggatgggaagccctccaatgtcactctccccttgtactacattgcccccgtgattcaattacctcccaccgtgtccctcccacaacacgtgggaattcaagatgagatttgggtggggacacagccaaaccatatcacacaacatttgaacttggaggaagggtctgtgcttgtcatatgttaggcagtgagacctgaggtggcgtccccgtaggtagcatcacctggagccctgtagttcctgctgccattcctcttgcaatgcctcctcccccagccctggcgacagatgccctggctggcatgtgattagggcttggagctccacccgaagtcctagggcctgtttctcaagttctacatttggtttaactgagttttcaggcccagatgtgtgtaatcagaaaccttgctttctggaagccagtatgggggcccgctttaaaggaagcctcaccaagctcataaaggaacaggtggggtgggcctctccccctgtcctgggcagcctggtggtctccagtgggctggaatgggcacaggaggggcctggctcgcccagtccccactctagggcaccactgggctcagctttatataatgtttcctttaggggcaaaacataaatgtttgaaaacagctgcattgaagaaaactgacagcaacgtaaaccatccccaggggctcgagcctaacagactgagtctccaggccacacagcagagaggcaggggagggccgtggtatgggaggctagctccagcctcccagcagctctctgcctcagtttcctcgtctgtaaaatagggataagggcagcctctcctcttaggatgtgagcataaaatggcttagtgcccacaaggctctgggaaggcctggccccaggcttgtgtttaccatcgtgtttctcattcgtctgccttctcttggcttggaagagagcaccttccagttttattttgttttgttttgttttttgtcttctgccaggcaaggctttttctctcgctgcttttcttcccctttgattacagcagaagtgaagactttgtttctctgtgtcacgtaaaataatgatgtaggcccggacatagcctgctaacttagagacccttggactctttcatctttggatcagacggagcagggcttgtgttctgtgctttgtgaggccagtggggggagcgaggcaggagcctccattcttttcattagcttctcaaggctgttgatcaaacagcctctatcttcctgaaaaacagctgaaagaatcaagtgtggcaaagccctgatgccctgctctgtggtaaatggagtgagtcattgccaaagtgtttaccgcagacctactgtgctcccgctaggtactttagcagactcaaaactgaatctggcagtccctgcctttgaagagtcctagccttttagtgaggagaagaacttgcagaggaagagcggctagctgagacctaggaaactgggagacggactgcttttcacatgacggtgtccggtctccccgacggcagtgtgggtcactccctctctgtctgcaggctcctggtttaagggcaccttccctgggaggcttttctgtctcctcttgtccaagcctacagaacctggagctgagcaagggtaatgtaggcattcacacatttagggctgaaattataaataggatggtcatttagagagcaggtgacgtttgagcagagacggcatctaggggaaagaggagttagacggagggaacagtgtgtgcaaagactgaggtgggaacctcgttggagcctggtctccaagcttatcatgattagtggcagtgaaaaccttaaagaaggcccggacagctttggtgcagtggaggggtaattgcattaatgacagaatgacagctcacagatacagcccacagccggctttctaggaggaaatgatctctaaaggcgtctaaacttttctgggacatgcttgttgagctcttcatctctgggcatttaagaagggagctttgcctgagctgacaggcattccatttggtctgggtaactaagggtcagatgtgttttgtttaagaaaatgcattctctcctgcctcctgagattggtagaatgttggatgtggctcagcacaccattttccttctaaaatatttattgctctaaaagcattgcatgatttaatatgcaacatgtaaatatttgtcagataattgcccaataacattcaaagcttgcttccaatgtcttctggatttatggttgttttgttccttctgacttgaggcagtgcaagctgccataattctttttcttaattcttctcttccacttactatcacctgaagttcacctttatggccttggcggctcttgagatgacagtgaaaacacacaaagtgtgttgttttaattgttgcagaagggcagtttaaatgtcagacagctcttggacttaattaggcccaaatacatgctcaatttaaaatactgcactcctgtcctgatgggattctgcttctgcgtgttcgtgtttgtttttgagactgagtcttgctctgtcactcaggctggagtgcagtggcgcaatctctgctcactgcaacctccgcctccggggttcaagtgaatctcctgcctcagcttcccacatacctgggattacaggcgtgcgccaccacgcccggctaatttttgtatttttagtagagacagggtttcatcatgatggccaggctggtgttgaactcctgacctcaagtgatcctcttgcttggcctctgaaagttctgggattaccggtgtgaggcaccgcgcctgccctgcttctgcgtgtttaaatttccagggtctcttggttacgttttccaaaggcccctccattggtttgttttgttaggtcagcaaagcccacatcacacccagtgtgggtgtttccctttactcttgaggtgcttaaaattaaaacttaattttcatagatttatagcgatgatcagggctttatcttgaaatgtatgtgagaaagtttttatttatttatttttttaatacttccgaaagatttataagctccagaatcacttttccccaaaaatgagaatccagttattgcaacagccctccgtctttaccaggcctcggtgctcatggcctgcgtgtgcacagcaacgggctgactagcatagaaagtgacttctctggttcttgttagttaccatagaaagtgaattctggcctcaggcctctgtatgcttgcggagggcctgcaagcacaagctttgctttttaggaatgtatgttaggctgggcgtggtggctccttcctgtaatcccagcactttgggaggccgaggcaggcagatcacttgagcctaggagtttgagaacagcctgggcaacatggtgaaagcccatctctaaaaaaataccaaaattaggcaggcatggtggtggacgcctgtagtcccagctactggggaggctgaggcaggagactcgcttgagcccaggaggtggaggttgcagtgagttgagattgcaccactgcgccccaggctgggcgacagaacaagacccgtgtttgaaaataaataaataaataaataaataaatagaggcatgtatgctagtgttttagttgcatctccaaattctgaactgtgagaaagcgggtgaggagggcaaattgagcagaatcctagaccgggagtccgaggggctggagtcagaggaggtctcagctgaaatgggcttggcgatgggtgggctggcagatgtctgcctcttcctcttctgctgaccgtggtggggagcattctgagtctagcagcagtagagaggcccatgtgttttttgtttgtttgtttttgtttttttgtttagagatggagtctcgctctgtcacccagtctagagtgcagtggtgtgatatcagctcactgcaacctccgtctcccaggttcaagcgattctcccgactcagcctcctgagtagctgggattacaggcatgtgccaccatgcccgactaatttttatgtttttagtagagacggggttgcgccatgttggccaggctggtctcgaactcctgagctcaagtgatccacccacctcggcctcccaaagtgctgggattacaggcatgagccactgcacccagcccccatgtgtttttgatataagaatgtcagtcatctgtggccacaatcatgctgcctaccaaatagctacaaaaccttacaggtgtttacaactgtaaatgttttgttgggggtggcctatctcagctgatgtaggctggatttgctcattcgtcttcattcagctggtggtcagctgcgaatggcaagaccaaaacagtcttaactgggaggactcatcgctgctccatttggtctctcatccttcagcaggctgtctcggcctgttttccatggcaggggcagggttccaggagagcaggctgagcaaatatggcctcatgatgcttcagcttggctgaagcatcacttctggctgctttgtcacgtattgcttctttattttattttatattattttgagatagagtctcactctgttgcccaggctggagtacagtggcataatcctagctcactgagccttgacctcctgggcacaaatgaacctcccacctcagccttctgagtagctgggactataggtgcacacctccacgccaggctaatttttatttattttttgtagagacaggatcttgctatgttgcccaggctggtctcaaactcctggcatcaagcagtcctcctgcctcagcctcccaaggtgctgggattataggcatgagctaccatgcctggcctcctttattcttttcagattctttaacaacatgactcaaataaccttttttttttttttttttgtcaattaggactcattaaagaagagaaaacaggcatttagtttttaaaaaaattccttggtataagtgtgtttgtgtttataacattgtaattattattattattggtcagctgccaacctgaaaacaaacaacaggtagaataatctacttcaagcctgtacttacagtgctaatttcccccatagtctgtgactttgcccctgatctacagtgtgaaatggagagagggctctgctgcgtttgggtttcttgagtacttattttaaaatcttatttgtttatttatttatttttttgagatggatctcgctctgttgcccaggctggagtgcagtggtgcgatctcggcccactgcaacctccacctcccgggttcaagcgattgtcctgcctcagcctcctgagtagctgggactacaggcatgcgtcacgatgcccagctaaattttgaattttgagtagagatggagtttcgccatgttggccaggctggtctcaaactcctgacctcaggtgattcacccacctcagcctcccaaagcgctgggattacaggcctgtgccaccgcccctggcctcttgagtatttatttgagccaacaggtgtccacactggggcttgtgcctggaacccagagtgtgcttttcatttcctagtcctgatctccagctctgatttttttagattgaggaaatatccatcacctcaaggggttaatagttttctgaaataaatttaaaaaacaaaatttggataaatttaaacaacaatgacaaagttgaaaaaaatgtgagtccagatttctgaggtgtttgcaccaggtagtctcccagagatggtggttcccagcttggactgtacattagaatcatctggaaaggtctataaaagtccaagtgcccaggccacatctcagaattaagtgagaatctgagggtaagataaggcatccgtattttcttttttctttttttttttttgagacggagttttgctcttattgcccaggccggagtgcagtggcgcaatctcggctcactgcaacctctgcctcccaggttcaagcaattctcctgcttcagcctcccaagtagccgggattacaggcacccgccaccatgtctggctaatttttgtatttttagtagagatggggttttaccatgttggccaggctggtctcgaactcctgacctcaggtgatctgcccacctcggcctcccaaagtgttgggattacaggcgtgagccaccacacccggccagggcatcagtattttctaaaactcccagagtcatttcaatgtgcagccaacactgacaatcactggtgcagactcttgaactcaaagtggggtcctgagacctggagcagggggttccctgctggggaacttgttaggagtgcagaatcccagccctccccaccaagacctgctgagtcagggcctacttttcaacaaaacctgccaggggctttggaggcaatggagcctttgagaagccttagcacagagcatctcattctaccctcggagccctgtgatgtggatgtgggtgtctgtgatgaatggatgaagttacaggttcagggaggtgccataggtgctcccgtggtggagccaggaggcagttccggtgtggtctgagtctgaaacttaccatccccacaacacatggcttcacctactgcccatgccgcagcgttagtgtcaggcagccccgtctgggcctgttccccaagtggacactggaatgtgacttctgtctttccttgtctcagaaaaagtgtgccactatgaatgcacttaacacccttcactgggcacctctgctgagcacaggctgacgtggttacacctgcttcttcctgggcctccctgtccatgcctctcccagctggaatgtcccttgccagaagtgtgggtcctaattcaagggccaggtaagcatcccagaaacagaggccagagagaaatgcttcattcttcattcccatctgatcagatgcctacttctgatctgagtttcatcagacctgacataaatatgcctctggaagcatacgtcgttatttctctgtttctttgaaattgctctcaaatcccaccactccaatccaatcagttgccactgagccagctgtgacatgggatttcacttctacctcaatttctgtatctctgacttagtagaaataagtaaaatccaccttcaactgtcctttaaattcagggacatcatttaaaaataatctcttccagctgggcgcggtggctcacacctgtaatcccagcactttgggaggccgaggtgggcagataacgaggtcaggaaatggagaccatcctggctaacacggtgaaaccccgtctttactaaaaatacaaaaaattagctcggtgtagtggcacacacctgtagtcccaactactcgggaagctgaggcaggagaatcacttaaacctcggaggcgggggttgcagtgagctgagatcacgccactgcactccagcctgggcaacagagcgagactccgtctcaaaaaaaaaaaaaaaaaaacctcttccaattcttttatggacatacatactgtattagtctgttttcatactgctgtaaagaaataaagaactgcctgggactgggtaatttataagaaaagaggtttaattgactcacagttccacatggctggggaggccccaggaaacttacaatcatggcaaaaggcaaaggggaagcaaggcatgtcttactacatggcggcatgagagagtgagagtgaggggggaagtgccacattaaaaccatcagatcttgtgagaactcactatcatgagaacagcaagggggaatctgcccccatgatccagtcacctcccaccaggcccctcctctgacatgtgggaattacaatttgagatgcgatttgtgtggggacacagggaaaccatatcacatacttaatgacatcaaggactcctgacaccctactttatcttaaactctgacatcatcagatctacaaacaggtaacaccatcatacccctccactccccatcacaaataaaaggggcctcctctcagtcatgctcttcacgtctgtgtggctgccatcaaccccttccttgccccgggctcttttacacacgcacaaacatgcgtgagcaggcgtgtacacacacacatacacacatatcattccaccggctgtgtagaagatatccaccttttgtgaatgaaacatattttctattttctttgttcacatattttagtaacttttctacatatttctttcaattaaaaggatttatgtattcttttacatatggaattatcttgacttaatttggagaaaaatttcacatggttatgatttagaattattagcccagtaggctgtaaagccaagctcaagaaaattcaaaaaaatggtgtcataaacaccatgttctctgaatttggttaattttttttttctagatctaacacaattctaaataactcctagataaaatgggaaaccataatgtaaattgagctgaaaagtaataaaaatattacatatcaaaatttgtggggaaaagcaaaagtggtatcttgaaggaaaattacaggtagcataaaactaaaggaaagaaataatcaaatgaaaagcagaaattgatgaaatcatgaagattatagatccaggacaaaagctgattctctgaaagtaataataaaatagatatttttgacagtagctgtcatcaaaaagagaaatagcacacatttgaaaatacaggataacaggttatagcacagttaaaacaaagattaaaaagagatcctgtaagaatgtcatcctattaaactttaaaactggccagctgcagtggctcacacctgtaatcccagcactttgggaggctgaagcgggagagctgcttaaggccaggtgctcaagaccagcgtgggcaacatagcaagactttgtctctacaaaaaaaaaaaaaattaaaacttagtcgggtgtggtggcacatgcctgttgtcttagctactgggaaggctgaggtgggaggatcacttgagcccaggaattcaaggctgcaggatgagctaggatggtgccactgcactcagcctggatgacacaatgaaaccctgtttccaagaaacaaacaaacaaacaaacaaacaattctcacttaagagtcttgctggcaggctgggcgcggtggctcacacctgtaatgccagcactttgggaggccgaggtgggcggatcatgaggtcaaaagatcaagaccgtcctggccaacatggtgaaaccccatctctactgaaaatacaaaaattagctgggcgtggtggtgcacgcttggaatcccagctactcgggaggctgaggcaggggcagaattgcttgaaccagggaggcggaggttgcagtgagccgagatcgcaccactccactcgagcctggcaacagagcgagactgtctcaaaaaaaaaaaaaaaagagtcttaattctatgccattgttgggccttacctttatgaataagtaaacagggcctggcaaacggaaccagttttctgtcctttagagctagagctaagggtaaatatgacgggcagagtcccctatttaagttggagagctttctgtaggttcccagagcatggctaacaccatctccagagaccttctgctgcacattcaagcacttctaggccactctgcttcccttcacagggacaccgacttacccttgctgatttaaaaataaaggaaggccagggaattacagggagtgaaaagagttggtctcagaaggttatatgctgtatgcttccattgacgtcacagtcttgaaataatgccgttgtggagatggagaactgatcagaggctgctggggccgagcgtggggaggggagaagtgttaccataaaggggtagctggagggggcctttcagtgctggaacctttttgtgccttgatggtggtggttacaggaagctacgtgggggttaaaattgtatagatggacgtatacacacacacacacacacacgattgtgtgcatacaggtgcaatctgaataagctgcatggattccagcaatgtcaagttcgtggcattgttattgtacagtaattgtggaagatgctacctttggggaggacaggtgaagggtacaagttcttgtggggctgtaactatttcaaaataaaaagttgaatgagcgtgaaaagctgcacgcatgacctttttcctgtagccttgtttccatgaatcgattgaattttggacatgaaagcagggtcagacctagttattaataggtgggaagaggactcactggaaatattgggcaacagaacctggctgccttcactgtggttcatgggccagcagcgttggcatcgcctgggagcttctaccaaatgcaggatctcaggcccctgagaatctgcatttcaaggtcctgagatgatttgcacatacatttaagtttcaggagttctagaacttttcttagagtagaaatccagtttgttggttgcatgatcctggacaagtcccatgatcttttgatctttagtttcctttagatacccatctagaaactgggaggcttactatgaagataataacacctcctagaggttctaggcagaactaacgagtaagttacagagaatgtgcttgtgctgtaatagacactcagtaaacagagctgttgtttctatgggcgaatgaatctccagatggttttccagtactgctagttccattttagccaaggggaaaagtggaagcaaattgaatgtttaaccaaaagaagagtagttaagaaaatagcacatccacatggtgaggcctcttttgtaactgttaaaagtggcagccagtgccatggggagaagcccagaagagagcagaggagggtgctggggcttctggtgcatcctgtgggcacctcggatgacgcgagggtggagcctgaaacgctggcccaggaaatggaacagaagcctgttgtgggtgggaggagaatcggaagcggcataaggagagtttttcaagaagggggaggaagctggtgccggggatggtcacaagcctttcctctttcttttcccttccctttcccctttccctttcccttccccttcccctttcccttccccttccccttccccttttcttttcttctttgagatggagtttcactcttgttgcccagtctggagtgcaatggcacaatctcagctcactgcaacctttgcctcccgggctcaagcagttctcctgcctcagcctcccaagtagctgggattacaggcacccaccaccatgcctggctaattttggtattttcagtagagacagggtttcaccatgttggtcaggcatgtctcgaactcctgacctcaagtgatccaccagcctcagcctcccgtagattacaggcgtgagccaccgcgcccggccgcctttctcttttcttcagcaccagttactgcaaagacccctggagtcggggcccatcctgggtcttgcagggactgattctgtccggtgtcgggctatgcacaggcagctgtggtggattcctgggttctccccacatctgcttccctttaacatgtcaaggcagccatccaaagggcatgaccctttccatgtgtagcgggagggtcagtctgtatcgcttccttctagaccttgcagcttttgtattttaaaactcgagagacaatagtcatctcctaaaaatagcagcagtgacatagctccgcagtcagttttgctggcactgggaattcagcttttgtctctggtgttagataacgggcaggtttctaggaaatgaattccatgtacagtagagccaggttcagttgacctcactggagaccttgaacccagcttgctgcaccgtggggtcctttaatcatctccctgctgacctccatgctttggagggtccaggtcttagggggacctgtttccttgggagtacaaaggccctagacacttaagagtcgcgtttcaggaagctggcacagcctgtgaggggccttcaggagtggggaaaggggcagtgccttgtcacctatatgtcctctgttgaagagtgaactgcaccaggccatctctgaggctctttcacacactgtgatgggtggaaggccactttcagctgcaagtacagaccctgtagatgatcagctcattctagtttgcctgggactttccggttttttgtttttagcactgaaaatcctgtatcctgggaaacccctctgtccccaggaaactgggatggttagtcaacctgcctatgtacaaggccacccttaggttgaggctgcacacagagtgctgcctaagagaagctgaaggacccaccaacagcagaatttctcctttagcactatctggcccctgactttggaggaaagcagcatgttaagttacattatctggaaggaagcactggactaaacttagtcccttatactggattcttttatcacacaagaaagccatcacccagccaagggcaggacccgcatggggacacaggacagatagatcttcttggggggattttgggagataggacagcccttgatcagagagggcccatggggtggagggtggggctggattggagttggggaaatgtagattaaatacatttcttgaaaaaaattcagttaagatatgctagagaagctacggtcaatttctttttaatagaaataatcatttttaaattttatcaagtgtaaacaaatctgaaccgttgggtttgtttatgaggcacaagtatattgagttaattttgaaaaaccccaaacctatctcattttttagagatagtgacttacagtgactctactaataattttattgggtctaagaatacttaagatactcttggctgggcgcagtggctcatgcctataatcccccagcgcttggaggggctgaggtgggtggattgcctgagcccaggagttcaataccagcctgggcaacatggcgaaaccccatctctacaaaaaatacaaaagttttctggtcatggtggcatgcacctgtaatcccaaccacacaggaggctgaggttggagaatcatctgagcccaggaagtcaaggctgcagtgagccgtgatcgcgccactgcactctagtctgggcaagggaagtgatactgtgtctcaaaaaaaaaaaaaaaaagatactctctccttttttttttaattccccagttttaatctggtagagggaccttgaaaatacttaaatactcatatcattcttatggattggtttgggtgtgtgagttctaacatagacaggaaggctatttttcctatcaataacatccaagaagcctgctaagtaatggtttttttttttttggaaaaaccatttggaaaagaatagattttcctgaactttattaaaacacaaatcaggtgctgaagggataattttgaaattctgtattttgaatgtctttccacttgcagaagaggtatgtagtttttaaaatttctgaatagaactacttgtgcatgactttgaaaaagtcactttcactcaaaaaataccaggttctttacctggaaaattaatcagtgcacatatagatgatctctagctctaaaaattgatgggattctatcttatgatttaaaaaattaaatgagtagtattaaatgattaaaataagtagtcacgggatgactaggaacagaattttttttttttaaagaaacctagtgagaaaggtcaaagtaatgggaaatccccaaaaagcatagtaaaaggaagcaatttgaaagtgaagaaaaaggaaccttttaaataacagctgtattgatacagaattcacataccatacaatttaaccgtttaatgtctaccgtggtttttatcatgttcacagatttgtacaattatccccacagttaatttcagaacattttcatcaattcagaaagaaccacataccttttagcttttaccctctattccccaccccctccagccctaagcaaccattaatctactctgtctgcctgtttacatgatttatgggaggatttttatgaaagaaccagatccctgtaattttatgtccccctatcttgacattttcctcagtaagagagtaggacaatcactccaccaccaggagtggctgccacatgcaagacatatgtgggttctacctgcaagggtctcaccataaattacctgtcaattacagtggaggatgaggggctgagtcttttaaagtatgcagagccctaagtctgactcattctgtgttgagcgttgggccacactgtctgctcattcatctctagttggtttgctgacctgtcgctgcagaggtcctccgagtgtggtccccacccagcctcacttgggacctcaccctagaccccttgctggggcagcagggtcagcactcagtattgagcaaaccctccagcggattatgttgcctgctcgagtttgagcaccatggatgtttcttgtcccccacccccagccccaccctgccacccttcaggttttctctaccctgctttcttttctgaagagaaggttgcagttggtttctctggatcttgtctgttctctctcactcttttctttcttttcttggtcctgcctccggtttggggtgggggcagctctgtggagagtaggccagttggctttgcctttggtggggtgtcgggggtgaggcttgggagggactcgggagtggagagatgttgacagaaatctgcttttgccagtggctttggtccggacttgcccctggaccaggtcttttcagtggcctcctcccactgcctcttccatccttccctctcttctggttctttccctccttttcatgaacatatttagatccctcctgtcattaaaaacaaaaccaacccaacactccaaactcacttggcagtgggttgggctctggcaggtcctctaagtcttctgcttcccaaggccaaagggctgccagtcggtgggtcccatgtcctcgtcctgcctccagccttggggtgggctggttctgcccttgccagcccagggcttctgccttctcaggctgcttctctgcagtgtgtattggctttattggtgggtgtcatgaaagcatctgtgcctggggcctggtcccaccccttaagtcctgatttcttccccatcccagccactgagacttctcatgaccttggcagggctgcctcctcctcccccagtgttttgggcactattgtcagaattggaacatgatgacaaacctgctttggggactgggatgccagggcagagtctcagattcccttggccccctgcctttcagccaggtgtcctaggggagagcagcctgtttgaggtgcacggtggcctggccctctgggctcgccaacaccgtggctcctaggaactgctctgcgtctgggatcctctaccctggatccgggagcctctttttgctttttgcttctttacactgctcatttttggtctcccctggatggtctggtttcccttcctttgttccatgaggcacttttcataggctggcctctttactccctgtcatggttagttttatgagtcagctgggctaggccacagtacccaggtattcagtcaaacactggtctaggtgttcctgtgcaggtattttgtagctgtggttaacatctacaattagttgactttaagtcaaggagattaccctctataatttgggtggacctcatccaatcagttgaacaaaaactgaggtttcctggaggagaagaaattctgcctcaaagctgcagcctcaactcctgcctgagtttccagcctgcctgcctgccctgtagattttggacttgccagcccccacaatctcatgagccagtttcttaaaataaatctctttatgtctgtatctcctcttggttctgtctctctggagagccctgacttatgcattcccataggaacattgtctgctggcagagcctcctcaggctcacgcagctggtgccagctctcagccctggaccactttcctaagagtcatgtgtgcattcagcctcatgtgcagagttcctcttgccagtcttcccccagcatctccttcttaacgtattccttttgcctccagggccagcttcctgggtatacagcctgtccagttcacaggcctgtgcttaaaagggccctatgtctgatgtaacactctgctgttactgttttgaaattcttaatggttttgaaccagggcctgcattttcattttgtactggggctgcaaagtacggagctggtcctagctgtccctgcgtttctggctgcccgtgtttacaatcctagagtcagcccagccttcctcatctcctgtatccagtcatttcccaagcgggggggatgtccaccatgatggtctcccacatttcactggggtctcacttaagcaagtgctataaccccccgccctggagtctctcaccagtctgttctgctgccacttctagatttatcttcatgtatgtggcttttttattttctttttaacaacagcattgtctttggaaactctccctgcagggctcctcccaacagttctccagatgcttccctctgtgtcacagaagccaggtgacttgctgtcccccagctgtgcgctgtgctgcctgctccctgttccgccatggtggatccttgttccccatggaccacacacctgtccctcctttgactgcaaggccactcagagttcccctcccatggacttcccgtgggctcctttgccgcatggcttccccgactttggaccctcatcgcagttcgcaacttggtatagatgcctttcattctgcgttgttttatattgattggtggatattttctcttgaagcttggtcagctccatgagggagatgctcaacctcattcagtttctgccctgtgcagtccggcagtttgtcgcacatggttggtggatgattgtccctgcttttttttttttttttcttgtttttgagatggaatcttgctctgtcgcccaggctggagtgcagtggggcaatctcggctaactgcaacctccacctccagggttcaagtaactctcctgcctcagcctcccgagtagctgggactacaggtgtatgctaccacgcctgggtaatttttttgtattgttagtagagacaggttttccccatgttggccaggctggtcttgaactcctgacctcaggtgatcctccctccccgggcctcccaaagtgctgggattacaggcgcgagccaccgcgcccgacctgtccctgctttttgaacatgattcaagtatcgtgccctgttgccagttacatatactattttgaaaattcttaaaaataggataggtctcagcactgtggacattttggttctaataatcctttgctgtgggaacccgtcctgtgcatggcaaggtgctgagtagcatccctggcccctgcccactggatgccagcaccagtgccttcccctctgtgacaatgaaagtctccagacattgccagtttctcctgttgaagtcactggaatagggatagagactgaagggagtaagattgttggagttgtgaacctgagtgccttcttacctggaaggatctgtggtatttggcacgcctcgctgctctctcctgcctcttcctcaccaagagttttgtcaggtgttttttacagttaaagaatttatgtactttggtaggaaaattgtgtttaccagcccttccaacaggcggtcctattctgtaagatggaaaatacctataattagaattcctggctctgtaaatgcttctctctttgtgatttggagtgtttgttgttgtttgaatcttaacatttgactgtatttttctcttggagttgtaataagacaagggagcttttaaaagtgtaatctgaggagattaaccccaggaggcatgaaatatccctccgaagatcacagtcggtctttcgaggacatcctgccacgtttacccagtgcccggcgtgagcagcctagaagacgagtggtggcagctgccacctgcccggtgaaaatgtaattgacaggaaattaatgaggggccagagatgactgttttatgcctaacagaaccacatgacacgtgttttaccaagaaatcatacatttggctttgattttcaaagtgatttttatgaactaataacacttcaagcaggcactttctctgttggaattctccctttaaaaagaactgtcagctgggggcggtggcttatgcgtgtaatcccagaacttcgggaggctgaagtgggctgatcacttgagcttgggagttcaagaccagtctgggcaacatagtaagaccctgtctctacaaaaaatgcaaaaattagccagatgtgggggtacatgcctatagtcctagctactttggaggctgaggcaggaggatcacttgagctggaaagttgaagctgcagtgagccatgatcatgccactgcattccagcctgggagacagagcaagaccctgtctcaaaaaaataataaaaaaaaaagaaatgtcacaaaacaatttgcattaaataagcctcttgattcagcatgaagttgcctctttttcagtttaatgtatttatttatttagcaaatatttattggacaggggtacctgtgccaggcgctgttctaggggacagaatgccagacagaaatggagattgctgctgaagtggagcttacgtgattttgggggtgagaaacaataacaagctcaaatacatgcacctcttctcaggagggagcaagtgctcaggagatgggataaggtaggcagggaaagggttttgcagcactgggctggtgctgaaaatttccgtcctcgttgaggaaggaacctttgagtaaagacctggaaggaagtgaaagtcttgctgtttggaggtctaggaaagagccttccaggctggtggagcaggtggtagagctggaatgttctagaagagccagaggtcagagggactacagcagagcaccatggggagagggcaggagatgaggtcagaagtgaccagtgctttactcacaaagggaaggacagacttgggtaaggagagctggaggggaaggaagaagacccaactccagtggtaagtgagagctctgctggcgtcgtgttgaagtttggtcctctttgaagtggacacagtcttccagggcagatcttcttaggctctggttgtggtgagctcgtctcttacattgtgcttacttagatcaatgccttttcagtgtttgtttaaatcaacaagtgttttcctggatgcctacagagctggaacctgaggtcccctaaacattgtccttgatggacaaatccatatttgggatgctgatctgtggtccttaacttagacgtcttaggtctgacttcgagtctccacagtcatttccatttgacaaagggagtttaagcatgtgattagatggggtctgtggagcatgtggctttgcttgttctagggaaaagaaacgcactgagaaacacctggaattagaaagcacttcctgggtgtttgtggcttcctctgtcagccctggagatgtggctgcccaaaggcctgtgtggctaacaggtgtgctggagatgtctggattgtagccttgctgggagccctcatgaaagacaatgcccgggcccaggtgtttgatgggttaccatgctgggtgagggcgctgtgccaatggcataaagcatggggtcatggggtcatggcctcatggccatggggtcatgcgtaaagcagagctgtgggtccagggtctgacagatgggactcactgcagggcccctcctctctgtcctcacctgaagcagttgcatccatcagtccttcgcccatcccagagttttggtgatggcttccctgtgccaggctttccgcaggagactggaggccaagacaagtacaagccacggggctctatcatcaaggacccaacaggcagcaacataggctgtggtgaagaccctgaattctatgttcttgtgggtcttgggagtttctctgttgtctctgctccatgctaattgcatagcatttctttcttccattatgtaacaccgagaaatacagtcatccttcaggacacgtgaggaatttgttccaggactcccccacctatacccaaatctgcatatactcaagtcccacaatccgctttgtggagcccctgtatacagagtcagccctctgtaggtggatttcacttcccacgatttggttgaaaaaaatctacctataagtgtactctgacagttcaagagttgtttaaggttcaactgtaacacagccctatatgaagaagaaagaaaaggctggtgttggtgccacagccagtggctctctacttgattggaagttcttgtttagacctgatacactgtgagaatacgatgtgcgttgggttcttgtaactgtgtgtgtgtgtgtgtgtgtgtgtgtgtgtgtgtgtgtgtgtgtgtgtatactgctttcttctctttattttccatacagtttataagaggacattcagaccaacaaacagttctcatcttcagtcttttagtgctgaataagttttgctgtgtggcatcttaatgcgcaatttaggaaattgctcttggtatcttgcagtcacagccagattcaattggtgagggatctttccagtgcaaacatggccttttccaatacatttacatattctgggacattactcatttgtttcctggcttttaacagcactgcaaatatgggccttttctgaaacatttacatagaccaggacattattattcatgtgttgcctggcttttaaatcaacagcagtatttacttagctaagaaattgggagactctttagcctactgaatttaaaaaagcagtgaagtgttgggggtatgtgaagttttcattgtgggagagtgtttccaattttagtgattttatttattatttatttatttatttatttattttgagatggagtctcgctctgtcgcccaagctggaatgcagttgtgcgatcttggctcactgcaacctctgtctcctgggttcaagcaattctcccacctcagcctcccaagtagctgggattacagacgcccgccaccatgcccggctgatttttgtatttttagtagagatggggtttcaccatgttggccaggttgatctcgaactcctgacctgaagtgatctgcctggctaatttttgtatttttagtaatgacggggtttcaccatgttggccagacatgtcttgaactcctgacctcaagtgatccgcctgcttcagcttcccaaagtgctgggattacagatgtgaaccaccacacccggccagattttagtgatgttaaagatctttctgagtagagttactttattttcactgtgaatgatcacattcacaacatgatccttattcttttactcggacaacattgaatagtaatatttattaggtattttattattcttctgatacaatttttttttttttggtgtggaaaatgaaaaaaaaaagagaagtacaaagaaaaaaacaaaaaccagtcacctgtattcccagtacctggagctaatgatagtgaatttttcggtgttcttttctgacttgtgctgtgaaatatatatgctctgccagattagctatctgtaaagttatctatctataaataaagttttgagtcctggtttattcacttgtaggggtatttctatattagaaatacttcagaatcttgattttaaaaatccaacttctgcatatatcatagtttattcagtaattttgggtcttttttgtttctgaaattttttgtgatataaataatgctctgatgtatgaatgtctaaatacgtctcttattggctctctgggcagttctgtttagatcaattccaagaaggtatattattggtatgttattattgtacccagttttccttccaccaacagggtatgaaattgcctgtttcactatatcctcatgacactgaatgttaattatcaaaaatgttgaaacggctttgctgatcttcaaaatattaagtcatgcatacttattgtaaaatattcagataacataaaaaggtaaaatgccaaagatgataaaaaagtgactgcgaattcatgatctaggcatacttatgtatttgaggtataactttagcgacatttaatataatacggtacttataatcttttttccttagcaccttcatgagggcacctttctttgccagcaaatacatgtcgtttttaatgaccacaatgtactctttctggatatgttcgtttctttaacctgtggcttcctagtggacattgaggttatttctggtttgcagattagtaacaacacagagatttgcacatctttgtacagaaacctactgactctcttaggaaattgttagattttgtttcgatctgtggagtaagttctcttatttttgaaagtaaatgtgcctttccctaaggtaggattagactttcctccccataacatcacacttggccatgtcacttgctctggccaattcagtgagaagtgacttgtgtaacttttggccagaagttttaaaatccagcgtatgatttgccatatcctttttcccctcttccgggcaacccacaattttccaggtagagttttctccatcagcctgagtcttgcaagggaaaacaatgtggaaaaaagctgcatgccaaccatgtggcatgagcaggaagcagacgtttgtcgtatgccattgggatgtggagattgcttgttctgctgcacagtctaactcagcctgagtgcatattagctagtggctccctagagagagtgaacttgcttattgtcatcacttatgcatatgaatactgcctcagcgtccatctgcttgtcctgttcccagcttgtcatgcttgactaacatattttgaggcagtcttcacgcagctcctgttttcatgttctgggtagataagaccccataccctgagctgcttgaccacattacttctgctttaagcctcgggaacctgataaggtaacccccgagttcctgtgctgagtctcgtgcttccttcaaatgaactaatccaaccgtgctgtgggaaacccacctaggtaaccccataaaggatccaacccacaggcccctccgtttctcgttccccacctgctggtcgaaggagcaggtcctggatggctcctcccctcttctctttggtcttgccaggggtgctgtcctcttccttccagacctgtgagtagtaaacttgattcattttgcagtctgagtgtccctcactgtgctgcacctgactacaccaagcctcaccatctcacttaacattacaacactgaagctttctagcaaggtaagggagtacatttccttctacactttgccaacaccaattaatttgactctgtttactcttttccaacttgtcaaaaaatgacacctcacttttatttgtgcatttttgttgattagtgaggctgagacatatttcatatcacatgtttactagccctttgtatttctttctttgaactaatttaccaattcctttgtcaattttttgattagtctgtcttatcttcttgaggtctaaggatttttttacatatgctaaagttattatattctgccttctttttctaatttgtcatttaaaaaatcttgtttggggtttatagagtttcctgaatatgcggcttgatatctcttgtcagttttggaaaattctctgccattatcttgtcaaatattgtttttgttccaatccctttttcttcctatcctgtgacaccaaattcacacacattagaccttttataccatgctgcctgtgtatgttatgcttttcttcctatcttttaaatcttttttttttttaattttctgggcatttttgattaaacttatcttttgattcactaatcatatctttaccctaatctactatttaattgctttttacattcttaatttcaattatgctgtatttctaaaatttttgattctttattgattctagttctgtaataaagttcctcatttgtcattatttgcttttacatattagttattttaaagcttgatcgttctaatttctggatcttctggggatgttttctattttctgtttttctcttggccctgtctcctgatacatctggtaatttttggaatgctagacattgtgtatgaaaattgaagtagcactagattgtgttatcttgtccagggaggatttagtttgcttctggcagacagagtgggacagaagattgcagtctaggttgtagtttttataagatctggcctctttctggcctgtcttgtaggatatagcccttttggcttcctatagaaatatggcctgggcagatcatgaataccacttttgtctccttaacccaagcttatccaacccctggcctgcgggccacatgaggcccaggatgactttgaatgcagcccaacacaaatttgtagactttcttaaaatattttgagatgcgcgcgcgcgcgcgcgcgtgtgtgtgtgtgtgtgtgttttcagccagtgttagtgttagtatattttatgtgtggcccaagacaattcttcttccattgaggtccagggaagccaaaagattggatacccctccctgcaaaccctcgagagtatgaccaactctgcttagctcctcctacccttcactactgctctctgcttggtttctcagcacccagccttactcagcaaatgcccttagggaaagccatgagaatggaagcttatctcaggatttccgccttctttctggaatacaatcaggcctgcaagtcctggtcgtcttggaaactggatgcctccaaatggatatttagggaaaaaaagtattcagttgttctcaggggaaaagtgcctctgattgaagccagtttctcagagctgaaagtgagagtccctgtcatttgcctttttactttctttacactgttttgctgagaaggtttaaatttttatacagtcagatgtatctatttctttatggtttccggccttgctctattgcttcaaaatgctgtttctaagccaggtttatagaaatagtcatctacattttttttagtggtttttttttttttttgagatggagtctcattcggttgcccaggctggagtgcagtggcaccatgtgggctccctgcaacctccccctcccagtttcaagcaattctcctgcctcagcctcctgagtagctgggacaacaggtgcgtgccaccatgcctggctaattttttttgtacttttggtagagacaggatttcaccatattggccaggctagtctcgaacgcctgacctcttgatctgccacccttggcctcccagagtgctgtcccgcaccgagcctttttagtgtttttatgattgaatatttaatgattcatttcagcctgagatgtgagataaagatccaaccttattttttttccgtatgactgggacttttgtccagaactattaatgaattcatcttttgtgaagatctgaaatgtaatatttattgttaagcatatggtgtctcattaatattttaatttacattattttgcttactagtaagattatgtatattttacatgtatttactggctttttgctattttttggtttttctactcattcctttacccttgaaaaattgtactcttggtgtatttatgctgatattcaatataatatttctgtttaaatcattctgtgaatgtcactaatcttgattgctttttcatttttctttcaattttacttataattttgatataagggaatattgtatttatatagtaacttacattgtatatttattgttatcttattatttttagcttttgaatctcttttctccatcagtaaactattttaggatataagtatgtatgtatgtatgtatatatattatacccttgactttttagtccttttgtattatcttttgattttatggtgtgtgtgtgtgtgtgtgtgtgtgtttactgctcagtaatcaacttttccagcaatgttggttgagtcatccatcactgcccagattgctcctttaacacatgttcccctttaaagacagggtcttattttgggccatctgctttattttcttctcaccaatttgtgggaaaactttattcttgttagtattctactttccttgtctcttatttttgttaaacagagcatatatgtgatagaaaatagaatcctggctgggcgcggtggcgcccatgcctgtaatcccagcactttgggaggccagggcgggcggatcacctgaggtcaggagtttaagactagcctggccaacatggtgaaaccccatctctactaaaaaaaaaaaaaaaaaaaaaaaaaaattaggtggacgtggtggcggctgtaatcccagctacttggaaggctgagcatgagaatcgcttgaacccgggaggtggaggttgcaatgagctgagctgagattgcaccactgcactccagcctgggcaacagagtgagactctgtcaaaaaaaaaaaaagaagaagaaaaagaaaagaaaatagaatcctgcagatgagcttgcagtgagagaccccaggcttcttggccacctgtctgctcctcagagctgtctcttgccactgttcccactttcatttcatctggcagtcccctccctgccagttgcaacctgctcatcatagctactcttggtttgtccatttgaggcagtggagatgattgtgtgcaatggtagtggagttttttgctgacttgcccttttcacccctctgatcagacccatccacccatcctttttcatatgtattcttttagtttcttatatatgttatttcaaccccagttccttctccatcaattctagctggtatttcctgacttctcctctgttaggtaaggaccttcctaaccttttcccaccaccccgtatccacccctcatattgtcttcgctagctttccacttacgagactagtaacattttcttggatcttaattatgcttattatttcaactttatctatagtttgattctaaaagtagaaaacaactaacccttatattataacactacagctattattagttgagtcaactggcataataggactctctttttttctgtgcagtaacatattttaaattattatcgcagataatatattttgctctgtttacttttttttaaagcattagctattaactcttttaagaaaaaacaaaataaagcaaaaacctgtaccatcaatgaatgtacgaccccatctgcaatgacagaatactttcctcccctttagacactggatatttgagtggggagcttctcaaaggggtcatctacacatttgttgtatgacatttactttttagtgccttaacttgccttgtactgtacctcacctctgtctcagtcgacaccctaccctgctcatcccaaccccaccctgggtcaacctcctgttcaccatgactccagcccaactcctccaaccctagctcacctccagagctctgagtcttcacctctccagcctctctccaacctcttctcctcccgggcaggggggctaacatcagaccccgactcaatgacccactcactccccaacccctcaccctggctcaacttccctgaccctggctcacctggatccccattccagcacaacccccacccctctcaactcacttaccctcaccccctcatgaaccctctgccatttaaggatagttcatctccttttctgctgcaagactactcttggctgttgagctacagttttttcagacccaaggcctgtgctgtctctgagccgaattctggtcccgtggcaaggcagaacctgtcccagagtctctgcagtgagcaaagcctagagactcaacagcgaggagtaaccacatgtgggagctgtcagctcacggggattttctctcctctccaagggcaggaattctcttcattgtcacagacctattccttatttaaagctttttttcactcttattcagggagggatgtttaaagagatcatgtatttattgattgattgatctccaatactgcagaaaatatgcattttaaaaacacacatccttctttttttttttttttttttttttgagacagggtttcttgctcttgttgcccaggctggagtgcaatgcccaccacaacctccgcttgccgggttcaagcgattctcctgcctcaggctcctgaggagctgggattacaggcatgcgccaccacgcccggctaatttttgtatttttagtagagacagggtttctccatgttggtgagactggttttgaactcccaacctcagctgatctgccctcctcggcctcccaaagtgctgggattacaggtgtgaaccaccacgcccagccaaaaacacattcttctttctacttgttattcccttcgtgcatgcactcatccccatgcatgccgagggcacatgttctggaaggcccctgggagccacatggggttcacgacctcaaaactgaagccctcagagggtatttgattcattaggtggggtaagacatgaacctaagaagaacgactccttgaaagaaaatgaggtaacaggaaaggaattcactgatacatgtcaggaacccagagctgcctgcgatgtgggtgggattcggcactgggaaaccttgtgtgtgggtccttcggggaaagtgggagttgactgccgttgagcgggtaggaaagtgccttccaggtacaggcagcaggagtggtgattgtcttggtagaggatgggtgaactgcaaatagagttgaaggagctgggctgagtagttgggatttcactccccgggtgattggtgggacccagcagggccagtcctgggcttttcctatggcaagtaactcaagagctgcaggagcagatgttgttaagcagagaggaaacaccaaacatggatccctatctctagcgagtgtgccctgtgactgtggagggtggaggggagtcacgccagagggaggtgctgtgttggggccagaccggagggttacatcctgagcaggagaggagggaggaggccaggtggaggagcggcctgggggacataggtggttgtggtgctagattggcagtggatttttttctgaaggctgccgtaacaaatgaccacaaagtaggtggcttaaacatcagaaattgattctctcacaattctggggggcagatgtctgaagtccaggtgacagcagggccacgctccctctggcagagctgggaattctgcggtctgtgacagcatcgctccaatctctctctgtcctcatctgtcctctgcacatctgtgtctcaaatctccaggatgatctcatcttaggatccttaattatgatctataaagatgctatttcccaacagagtctcattcacagcgaccggggttaggatgtggacatgtcttttctgggcgatacatttcaacctactacaggcagttacctgaaggagtaactgaaggagaggggttcagaatcctccagtggggcctgatgggcagaggagagacttggacacccttaagagacgaaatgaatcttcagaggttcagccattgcttgcaatgtcatcttctgggctcatccctgcactccaaccctggacattttctctggtcttttctagtggccaccatctggatgattacgactctggaaatctctgtccatcatccatttttttgcctcctctgtgaacgagcaggtgtgatggcctgaaaacagagagggagaaggctgagtgtaccagggcaggggaagcgcttcctggaattacgtgtcccaggacaaaagtgaaactgccttcgctgactcataggaaagtttgaaaatatcatgtttcgcctatgcctgggggatctttgtttttggcataagccgaacagattgttccaggccagaaaaaaactaagccaaaccaaaacaacagaatgacttaattatgtaccagcaccctttaaaattaattatgcttgctttctttttgtccccctcaacttttagtttaagttctgaggcacatgtgcaggatgtgcaggtttgttacacaggcagtgtgccatgcccattgtggtttgctgcacagatcaacccatcagctaggtattaagtgcagaattctttagctattcttcctgatgctctcctgcctcacaccccctgataagcccctgtgtgcattgatccccaactgtgtgtccatgtgttctcatcgttcagctcccacttataagtgagaacatgcagtgtttgtttttctgtttctgcattagtttgccaaggataatgccttccagcaccatccatgttcctgcaaaggacatggtcttgttcctttttatggctgcatagtattccatggtatataagattatgtaaagagatcgaacctacaactgattggcgtacctgaaagacatggggagaatggaaccaatttggaaaacataattcaggatatcatttgtgagaacttccccaacctagtaagacaggccaacatttaaattcaggaaatgcagagaaacccagtaagatgctccatgagaccatcaaccccaagacacatcatcatcagattctccaaggttgaaatgaaagaaaaaatgttaagggcagccagagagaaaggccaggttacccacaaagagaatcccgtcagactaacagtggacctctcagcagaaaccccacaagccagaagagattgggggacaatattcaacattcttaaagaaaaaaaaattccaactcagtttcatatccagccaatctaagtattcataagtgaaggagaaataagatccttttcagaaaagcaaatgctgagggaatttgtcaccatcaggcctggcttgcaagagctcctgaaggtagcactaaatatggaaaggaaaaaaacactcccagccacaacacactgaagtacacagacaagtgacactatgaggcaacaacataaacaactctgcaaataaccagctagcatcgtgatgacaggatcagactcacacatagcaatattatccttaaatgtaaattggctgaatgtcccaattaaaagacacagaatagcaagctgggtaaagagttaagacccatcagtgtgctttcttcaagagactcatctcacatgcaaagacacatgtaggctgaaaatgaagggatggaggaaaatttaccaagcaaggggaaaacaggaaaaagcagggagtgcaattctagtttctgacaaaacaggctttaaaccaacaaagataaaaaaagacaaagaagggcattacataatggtaaaggagtcgattcaacaagaagagctaactatcctaaatatatatgcacccaatacaggggcacccagattcatgaggcaaatttgtagagacctacaaagagacttagactcccacacaataataatgggagactttaacaccccactgacaatattagatcatcaagacagaaaattaacaaatattcaggacctgaactcagctctggatcaagcagacctcatagatatctccaggactctccaccctaaaacaacagaatatacattcctctcatcactacatggcacttactctaaagttgctcacataatcagaagtaaaacactcctcagcaaatgcagaagaactgaaatcataacaaacagtctctcagaccacagcacaaactaattatgctttctaatgtgaacctctaattcttggttatatcttgtacatacatgtgtttttttcttttagttttggatttctggaccttgacatgtttaccaggagtactagattttcttgctatgttccttttcttggcatatgactttgatccttctgaggggttggagtcagaagccaattaccactactttttcctgcctcctcccacatccagatgtctgttctccagcctccatctcttctaagtttgccttctcctctcagtacctggatgtgaccaccccattcagtggcgtcatctctacctagtgactcctaggagacttttgagtattttctgacttctagcctgccccttctagcactctcaatgccttgttgcgttttaaccatattttatattttgttttttgtttttttttgagatggagtcttgctctgttgcccaggctgcagtgcaatggcacaatctcggctcatggcaacctctgcctcctgggttcaagcgattctcctgcctcagtctcccaggtagctgggattacaggcatgcaccaccatgcctggctaatttttgtattttttgtagagatggagtttcaccatgttagccagcctggtctcgaacacctgacctcagatcatccatccgcctcggcctcccaaagtgctgggattataggcgtgagtcactgtgtctggccatgatttttgttttgttttgttttgcttttaattaaaaaaattttttttaatgtttagagacagagtcttactatgttgcacagactggtcttggaactcctgggctctagcaatcctcccatctcagcctcccaaagttctgggattgcaggcattagctactacacctggccaatcatattttatgttaataatacttggttagccaggcatggtggctcatgtccgtaatcccaacactttgggaggctgaggcaggtgaatcacttgagcccagaagtttgagaccagcctgagcaacacagagaaatcctgtcttaaagaaaaaataaaaaaatactctgttgaggtataattgacatatgataaagtacagaaattctaagtgaacagccgtatgattttgacaaatatatacacctgtgcagtcatccccctactcaagatatagagcatttccatcaccatagtaagtttcctcttgctcctttctactcagtccctgtctcatcagaggcaaagacctgttgttcagatttctgtcaccatggattagtttagccagtattgaaaattcagtggaatcacacagtgtgcgctctggtgcctggattctttcactcaacataatggttttgagatttagccatgttgtgtgtaccactaggttgcttttttttttctttccatagttaacaactttattgacaattcatccattaaagtatacaacttgatagtttggggcatattccattattaatttttaaaattgtggtgaaatatatataacataaaattgttcattttaaccattgtaaccagtgtacagttcagtggcatttgcaatgttgtgcaaacattatcactatttccaaaatgtttttatcatccctctccccccagtccctcttcctcctcctaccctcttcccctcagcccctgataacctctaacctattttctgcctttatgaatttgcctatcctacatatttgcataaatagaatcatacaatatttgtctttttgtatatgggtaatatcacttagcatgatatgctcagtgttcatctatattataaaatgtatcagaatttcctttttttaaaggttgaataatattccatcatatgtatataccacattttgcctgtccatttatctgttgatggacatttgggtattccatgttttcactactgtgaataatgctgttaggaacatgagtgtacaaatctttgtttcaacctctgctttaaactcatttgggcatatacctaggagtggaattactggatcatgtggcaattctatgtttagctttctgaggaacaaccaagctattttccacagtggctgcaccacattagactctgaccagcaatgcacaagggtttgtttcttcacatccttaccaaacaaacacttgttatttttttatataggtgtgttttaaatggtagccatcctgataggggtgaagtgatttcttattgtggtttagatgagcatttctcatgactcagtgactaatgatgttgagcattttttcacaggcttattcagcatttgtatgtctgcataggcaaagttgctttttctgctatcattacttcattgagagataatttacatacagtgaaatgcacaactcttaagggtgtagttcagtgaattttcacaaatgaatatgcacatgtaaatgtcactcagattaagatatgattccattaccccaggaagttctcttgtgccattttctaataacccccttcacaattttttattaccatatacagtattaatcttgcctgtccttggatttcattaaatagaatccagcagcgtgcactttttggtgtctggcatattttgttcaatgtaatatgcatgagatccactggcattgctgtgtgtatcaggattttgttcttcttttgttgctcagtagtattcccaagtttgattatagcagactttgcttatctagtctcttgatgaatatttgggttgtttgcaattttgggatattatggataaagctgtcctgaacattcttgtatacatcttcatgtggatatagactttaatttattttgagagagtatccgtgaatggagttgctggctcataaggtagacatgtgttaaactttaatagaaactgccagtttcccagtgtggttcttccattttacactcccacctgctgggaacatgagagttccacacccttgccaacatttggtattgtcagtctttttaattttaaccattctggtgggtgtatggcggtatctcattgtgggtttaatttgcatttccctgtgactaacgatatcgagccctttcacatttggaaaaggttataatttaaattttgtacattaaaaaaaaatcaagttagaagacattaatgaacacctgcagaacagacatcccaaagcccagaatgtcatgtggaagccaccgccctgacagctatgagtcagacagacagatgtcagtttcagttacaccttaaatcacaaatgagttgccaactcagtttaaaaagaatagggttggggggcatatatttaaagaatattttgaaaatagaagaaaatgtggcaaggctgtctcctcccacaccagctcccacctgagagccagatagttagcaggaaaatctgatcacgctgctttctaagaccctgcgtggttctccaccaactttggatgcacttcagcctcctcagccctcgtggaagcccgtcatgacccagaattccccactcgtcagctccacgcctttgcacatgcttgcctcccgcctgggacacggtccctccaccatccctggcgctgcggacctcccaccattgcttggctaacgaggctcaacctggctgggtgccaactcctcccagcctgggcaagttgccagtcatctgtgctcccaccatcctctgggccgagcctggcattctcattgtttacttctctgcctccttccccagactgaatgtcctgaggggagggagtcgcatttcagcaatctttgtattttgaacacacagccagggaccagtaagcctgctgatggtgaataaatgctcatgggtgatgacgacagccagctgaaagcggtgcagccctcctccctgcggggcatgctctccgtggatgtgctggtttagtcacacacattttaagtgtgacgacacctatatattcctaaatctgtaagacaaagtacaagccacaatatctcgagatctgcccttctcctttgaccactccaccccagcctatgacagggggctgccatttccccccatggggccagggatgactcttggtagagcacccaggagctggtgcacatgagaacaagaccagttagggggcatgtgagggagtgctgtaggcatccaggccaggactaggtaagaatttatttggatttatatatagcagagactgggcaagacaagaaggtgggtgcgttgccccactgaaagaaagccaatcaagtaaaaatgaacaagaacacaagctgagctctgtgtcctgtgtccccgaaggggtgactgagcaacctcggtgcctgggtgtagagataacaccaccactgtccatcccggggcctcacccagggcgtcagcggagcatgctcacactttaggtcctgtagacaaaagtaattgcaggctcccagccaggagcctgggctgaggcctgaggatctgcatttctaacacgctcccaggggacgctgatgccgctggtcctgggactgcactatgagtggccaaagtcaaacctgcgcctggcagaaaacagtaaataggtcgtttggctcaatcattagccaggttgttaattctgcatccattggtttgggttgtactaaattaggccacactttttgtgaggtggaccagtatttgtgcatgacaggcccaatatttgtgaaaacattgccttgaaaatagttggagaattttatttctcatgaatagaacatgctgtcgtctgagagcctgcctcagagcagctggctgggagcctccggagtgggaaccgctttggcagagtaggtaaaacattcaaaaagggtttcaagtctttgagtctgaaacgagtggacaatgtagattcctttcatgaaattgtatgcagcattttgcaaggaacttataaagctgatcatagtctatagatcctgaaggtccaatttgctttccattgattgcttgtcatttttttttttttttgagacagtgtttcagtctgtcacccaggttggagtgcagtggcatgatcacagctcactgcagacttgacctcccaaactcaagcaatcctcctgcctcagcctctagagtagctaggactacaggtgtgcaccaccacacccagctactttttgtatatttttgtagagacgcggttttgccatgttgcccaggctggtctcgagcttctgagctcaagccatcctcccgtctcagcctcccaaggatctgggtttataggtgtgagccaccgtgcccggcctgatggtctatttatattctcccaactctttctagaaaaggatgggaggcagctttctgtcttctgtacagttttctcacagcccgtgaatccacttgtgtagttaagcaggagactgggaagcttcatcagaattttttcatccttaaaaaaaattttttttttttgagacagggtctcattccctcgcccaggctggagtgcagtggagtgatctcagttcactgcaacctacgcctcccaggttcaagtgattctcctgcctcagcctcctgagtagctcagattataggtgtgcaccaccatgccaggttaattgttgtatttttagtagagacggggttttgccatgttgcccaggctggtcttgaactcctgacctcagatgatccacctgcgttggcctcccaaagtactgggattacaggggtgagccactgtgcccagccccatccttaaacattttgtattttctgattattaaataaaaatagatgttcattgtagggaaaaatgagactttttacaactttttataacctattcagaatcaattactactgaaggcttagtgcatttctctcttgttttttgtcatgcagtgttaatagatgattttatataattgttttaaatgtatatttatcttatggtaatttaagcctttcctcatgattaaaattctttatatacctcaattttactaatatttgataaatgtaagattataccatagaaaaatgtttttttttaaactttttaaaataatttcaaaaggagaactttttttttttttttgagatggagtttcactctttttgcccaggctggagtgcaatggtgcaatctcggctcactataacctctgcctcctgggttcaagcgattctcctgcctcagcctccccagtagctgcaattacaggtgcctgccaccacacccagctaattttgtatttttagtagggacggagtttcaccatgttggccaggctggtctcaaactcctgaccttgtgatccacccgccttggcctcccagagtgctgggattacaggtgtgagccaccgcgcctggctttttttttttttttttttcagacagagtctttctctgtcacccgggctggagtacagtggcgtgatctcggctcactgcaacctccgcttcctgggttcaagtgattctcccacctcagcctcccgagtagctgggaccacagatatgcgccaccgcacccggctaatttttatattttttggtagagatggggtttcgccatgtcgaccaggctggtctcgatcccctgacctcaagcaatcctcccacctcagcctcctaaagtgctgggattacaggtgtgagccactgtgcctgaccaaaaggagaacctttttgaaaaaaaaaaaaaagaaaaaaaaaagaaaaatatagcactctcctggtgtcttctgggagtatagtgaagtccagagaggagattttcttagctgagttgcagaattaattatatctaatctcgctgcacctaacatctagtagatctcaatggctaataataaaatactaatatgttttatttaattatatattgtcttatataaacatatattcaactttaatgaatgatccagttctcaagacagaaacatagaattatatgttaatatgacaggctttggaaaattgtaactggattttgtcattattctatccttatgacttgttgatgtttgtattatctaatgctacatgcatcaccccaaaacacagtggctttaaataataattatcatttattttctctcacagtgtctatggctcgggaatgtgggaacctggttgggcagttctgactgagggtttctcgtgagttgcagtgggatgctggctgtggctgtagttgtctgaaggcttgactgaggccacagggtcctcttccaaagtggctctctctcgtggctggcacattggtgctggcagttagctgggggcctcagttcctctccctgtgggtctctccatagagctgcttgagtgtccacagggcgtggcggccggcttcctcaggagcctgcaatccaggagaccagggtgaaagctgcaagatcttttaggatctggccttggaaggcacacaccattactcctgccatatggggccagccctgatgcagcatgggaggtgatcaccaaggatgtgaataccaggaggaaacgaagatcattggggccatccaggaggctggctaccacagttgtggttgtgaatattagaagtacagggtatggaatgaataagaaaagtatactcatgacagacatacatggtactaggacagggtctgtgtttttgctgttgtaattcatcccctgcatgacctctttctcattgagtttctttctttccttttcttcttcctttttttttttgaggtggagttttgttgttgttgcccaggctggagtgcagtggcaagatttcagctcacagcaacctccgcctcccgggttcaagtgattctcttgcctcagcctcccaagtagctgggattacaggcactcgccaccatgcccagctaatttttgtatgattagtagagacagggtttcaccatgttggccaggctggtctcgaacatctgacctcaggtgatccgcctgcctcaacctcccaaactgctgggattacaggcatgagccaccatgcctggctgagtgagtttctgtgttccgctcttctagccttgctagttcctttaagttctctgtcgagctttgtacatctgttgtaaaaattccaagcttaatttcagaaagattaagtgaatcaatggttggaagaacatgtaattgttactgacagtcactgccttcaggtcaacggttaacaggcttagttttctttcatcacataatgcttgtatgatcactgcgtggaaaccactcccagtgttgggaaaattagatgagcctctgagataggaatagattaggtatatacatgaagttggcagagggaatacagttgaacaaagtagtggtttcatacattactaatctaaaatcataaatcccagcgagaggtttgcagtgataataagatttacgttttatgcaaaatttagtctaaagggaaattgttttgaattactgacaaccttgaatttatcaaatcctgattacagggctacaaggtgaccccatgttggaaggaattatcttgatgtattttacatatttatttattttattaataaaatgtcatttctttatttaaaacagtttattaggcatctctttatttgaagcagaaaagcatagataaaaatacaaatattggcctggcacagtagctcacgcctgtaatcccagcactttgggaggccaaggtgggcggatcacaaggtcaagagatcgagaccatcctggccaacatggtgaagccctgtctctactaaaaatacaaaaattagctgggcgtgttggcgagtgcctgtagtcccagctactcgggaggctgaggcaggagaatcacttgaacccacgaggtggaggttgcagtgacctgagatcgtgccactgcactccagcctggcgacagagcaagactctgtcttttttttttttttttgaggtggagtcttgctctgtcgcccaggttagagggcagtggcgcaatctcagctcgctgcaagctccgcctcccaggttcatgccattctcctgcctcagcctcctgagtagttgcgattacaggtgtgcgttactacacctggctcatttttttgtatttttaatagagacaggatttcaccatgttggccaggctggtcttgaactcctgacctcaagtgatccacccacctcagcctcccaaagtgttggggttacaggcatgagccaccacgcccagcccattttataagtacattttgtgcccaatcaagtatcaaagacataatcttaaaataaaggacagttcttcccaagggaaaaagaaagtaggcaacctgacacatgaatagatgatgtatgctactgttacacgcacacacacacactcagaatagactgtgatgctgtgataacaaaccacttcaagtcccagtggcttaaaataacaaaggtttgcctctcgctcattcatgctgttgtgcgccggctagagggggcagggctctgctctctctgccctcactccggaggcccagtctgggagcagttgcatctctgagcttcaagggcagtcaagtcaagaaaagggaaggtggcacatcgtccaccgtctctcgaaacttcctcctggaagtgacacctgctatttcacttacgtttaattacccaaagcaaaccagatggtcaagtcagaactcagaaagggtggggaaatgcaattttaccaagaggcaggaagaaatagataacggaataacgccagtgagtactgcagctgaatccagtgcaactgaattgtcctggttcaaacaattaaaaaagactttgtgtgtgtactttcaccagcttcttcacagaccgtcgcccatacttgagtgaatcttcctcctgtgcatgctactgtatatgataagtggaagagaatagagagtgttgtcagggacatttttgaggaatactgaagtctacttgggacagtgaaacacactggacgatgagcttccagctgcttgttttcctgctggactgtctgtgagttcatcttcttatttaaagctccttgttactgagtgcctcctagcagcagtttcctttagccctctctaggaggagcacaaatgcctattcctggcagcctgagcatgtcgtcttaggcgtcctctcgtgacctgtggtctggtgttttgcacaatcttcatcaccactccttctagaaggactgagaactgaatttgacttttaaaacgaagcttggtaatcaagaatagcaacagcaggctgagtacgggggctcacgcctatattcctaggactttgggaggctgaggcgggtggatcacttgaggtcaggagctcgagaccagcctgatcaacatggtgaaaccctgtctccactaaaaaaatacaaaaaaaaaaaaaaaaatgggcgtggtggtgcatgactgtagtctcagctactcaggaggctggggcaggagaatcgcctgaacccatgaggcggacattgcagtgagccaagattgtgccactgcactccagcctaggcaacagagcgagactccatctaaaaaaaaaaaaaaaaaagagccgtggtagttctgaaggggaagagcaaggaaggtttcttccctgcaaaacacaaggctgcagtagcgaatcaggattgccttggggctgaggtagattgttagaccaatgggagcaactctcaggttcattcctgtgtttatggggaggtgggatgagcttgagcatgctgttactaccaatgggaaaagaatggatgtgttcatatattgtgctaggaaaacagaaaaaggtaaaattaaacttctataataaaaaccatggtggattcaagacctcactatgaaaaaaaaaaaaacttgaaactgttgaaattaaatacagaggaatatctttagggtttttgaatgggaggcattgcttaaacgcatgacaaaaagcattcctataaaggaaaagattaataatatgactgcatcgaaacgtaaaacgggatggtaaatgaaaaacaagtggtgtcgagaaaacaatcgcaacacccttgacagagcttcaggtccaggggcagcatttacagaggcacctactctctgtggtgcctgagagggagcgcctctttaaatttggtgccccagggcctcctttgccacatcttagtgccagccttgggcgccagtgccatcctgatgccagctttagtgtctagggctgtattgcccagtagtgtagctggtacctccaagtggctgtggaacacagtgcaactgaggtgtgccgtaagtgtaaaatatgtactagattcatccaaaaaaggtaaaatagctcattaaaatttttctattgattacattttgaaatggtaatattttggatatgttgagttaaatacaatatatttattaggatttcatttggcttttattaatttggccactagaaaattaaaaattatcagccaggtgcagtagctcatgcctgtaatctcagcactttgggaggcagaggtgcgcagatcacttgagcccaggagttcgagaccagcctcggtaacatggcaaaacaccatctctacaaaaatacaaaaattagctggatgtggtggtgctcacccatagtcccagctactagggaggctgaggggggaggattgtttgagcctgggaggcgaaggctgcagtgagccgtgatgcactccagcaggtaacagaccaagacctgtctccaaaaaaaattttccattacatttgtggctccccttatgtctttattggacagcactgtcctcaagtattataaagaattcaaactgggctaggtgctgtggctcacccctgtaatcccagcactttgggaggctgaggtgggcagatcatttgaggtcaggggttcgagaccagactggccgacgtggtgaaaccccatttctactaaaaatacaaaaattagccaggcatggtggcaggcacctgtaatctcagctacttgggcagctgaggtgggagaatcgcttgaacccaggagatggaggctgccgtgagctgagattgtgccattgcactatagcctgggtgacagagtgagactccatctaaaaaaaacaaaacacacaaaaaaagaattcatactgatcaatgaggaaaagacaaagaagccaatgggaaatggacaaaagacataattaaatccttcaccaaagaggaaatccagacagccaatagatgcatggaaaggtggccagtcttactggcaatcaggaatgcgaagtgaaaacacaataacaatgtttaagcatccgattggtgaaaatgcaaaggtattgggaattggtgagaatgaagaaaaactgtaactttcacccatgagtggtggagttgaagttgttgcagccgctttggagaggactttggctcatgttctacccccagcttgtccacttagagcactggttctctcctggggcaattttgcctcccagggtgcatttggcaatgtctagaggcattttgggttgtcataaatgagggtaggagatgctcctgacgtctaatgggtagagaccagggattgcatagtacaggggacagccccccccccgaataaagaattatctggccccacatgtcaatagtgccctggtcgaaaaactgacacaggcgaggatcgcaattaatttccagctcaggtgcatcaggagatacagatcaaggttttaatttcagtgctctctgtatttgtagtcacagaactttggacacagtgtctatcagtttaggggcatggatgaacatgcagagacactatagcagtcacgatgcatttgccagtgatttggctgaatcacgtccagcactgcgtgaataaaccaagtttcaggctcagatgtacatggagagcattttgtgcaaatagttgcaataggaaataatgctccctattaaatatatcgcttgggcacagtggctcacgtctgtaatcccggcactttgggaggccgaggtgggtggatcacctgaggtcaggagtttgagaccagcttggccaacgtggcgaaacccgtctctactaaaaataaaaaaattagctgggtgtggtggcgggagactgtaatcccagctacctgggaggccgaggcaggagaattgcttgaacctggggggcggaggttgcggtaagctgagattgcgccactgcacttcagcctgggcagcagagcgaaactccttctcaaaataaataaataaataaataaaaatatattgtttatggatacatgcatatgtaataaaaattcaaaagcaaaatcagagcatacacagctgcaccaaatagtgatcacctctgggagggatggagaagaaagcacaaaaaggcatttcaactttttctgtaatgttgattcctttaaaaagtttgaagccgttatgacaaaatattgacctttgttaatgttaccaatgaagacatgggtgtttatcttacttatcttactttctattttacttttctctatatttggactttttctcataataaactctgatacacacataccaaagggcacttggaacaggggctgcctgagtctaggcagctcagtgggggttgtccctgtgtctgtgtggttcgcctgcttttccccaacactgatctgtggttaagagtttggtgcatggaacgttccatgggattctttattatgagctggctttggagaagcagtgggctgaaatggtggtgtctgacctgcggtgctggggccacaccctgtagggattgacccttgggtcctgcctcccggccaggaagtcctctccccttgccacttgccacccctctgcactagacctgggcctgacctttaccctccaaacttctaacaacacatcccagaaaggatctggttcaagatactaacaatcacacttggggagtgtatttcaaggaaaatagatggcatatcgtagaaattgcagacaaacctgaactcctggggagtcccttcagaaaggaagtttgctgcctggttgagacttgattgggaagggtttgccttgtatgacacccagtgcctagtgtagtgtggaatttaaggccagcaggtggtgattgatatgcacacttggtcttctctacaggccacatgtgttgaagattccctgccttactggggcctccctctcatgctctttcattctgtttaggcccagggaaaggattcctgcctgtggcgccgggcttgaggctgcagtactcaccatttttctatgatatgttgaagcaatcaactggtgttgagggatcttagaatttttaagacttgtatgaagtatccttccctttggaatcttgtttggagaatagcttaattagatgatgtcttagtccgtttaggctgctatagcaaaatacagtaaactgggtggcttataaacaatggagatttatttctcactgtttggaggctgggaagtccaagatcatgggcctgctttctgtttcatagacagcaccttcttactgtgtccccacagggtggagaaggcaaggcagctctctgggtcctcttgtataagggcaccaatcctatttatgagggctctgcccttatgacctggttacctcctagtggccacatctcctaataccatcaccgtgagggttaggatttcaacatatgaattttgaagggacacaaacgttccgtccatggcagatggtaaggctctgtcaccagaagaacatttgagtcagtcttcattcacgctgcccgagtattcttgcattacctgtgtgaactgaaccaggaagttgtcccctcacagggaatccatctctcttgcgccgttgcagctgctgcgaccaaatgctgtcatcgatgtttatcctggatgcccaccccgtccccagcgcaagattcttttcttagacccctgatgattttaatttgcattgtcttaaaacatcctgagatgattgaaacttgcctaaaatagtttacccagcaaatcacacatgtgttagcaggggctcatggcagccttttagaaatatagtagctctttagaggccagaattcttgcattcattcataaagccacatagacatctcccccgacctattgctggtgttattatggggttttatagaaatggagttttaagtatctgaaatgtactctcttcgttcttggaattttttctcacactcgagcatggtaacatcctttttcttctggggcatcaggatgatggctcccctactgtggtaccataggccccacgtggctctggggctccctgggcctctggtgcttcagtctctcccctggctgtcgtgggctcccgcttcttcttctgcagactgtgctgggcctcacgcagcatccggccctcctttttccttcagacagctcttgtttgcatttgtttatagtggttattgtaaaactatttcttaatgaggatttttttttttttttttttttgagatagagtcttgctctgttgcccaggctggagtgcagtggcacgatctcagctcactgcaagctctgcctcccgggttcatgccattctcctacctcagcctcctgagtagctaggactacaggctcctgccaccacgcccagctaatttttttttgtattttttttagtagagatggggtttcaccgtgttagccaggagaggatgttattaatgtaaacattgtgtttgcttacttttttcaatgttaattaaaatgatataatttcctcatgaatacagctttgttttacataagaattctaactgcacagaatcatatggggtggctcacgcctgtaatcccagcactttgggaggccaaggagggcagatcacaaggtcacgagattgaaaacatcctggccaatatggtgaaacctccatctctactaaaaatacaaaaattggctgggcatggtggcatgcgcctgtagtcccagctacttagcaagctgaggcaggagaattgcttgaacccaggaggcggaggttgcagtgagccgagatcgtgtcagtgccctccagcctggtgacagagagagactccatctcaaaaaaaaaaaaaaaagttgaaagtagttcttccaaaatgttccttccccaccccaccaaccctggattagtcaggggtctccagagaaatcgtgtgtgtgtgtgtgtgtgtgtgtgtgtgtgtgtgtataaacatatatgtagagaaggagagagatttgaggaactggcgtgtgcgattgtaggggctggcaagttcaaaacttttccatgaaaagttcaagatctgggtaagagttgcagtttgactctgaaggcagtgctgccggtcaagtttcttctttccagggtgtggggaggccagccttttttctcttaaagtcttcagctgattggatgaggcccactcacatgacggagggcatctactttcctcaaagtctgttgatttaaatatcagtctcatttaaagaataccttcacagaaatagctagaataatgtttgaccaaatacctaggtactactgtggcctagccaagttgatacatgaaattaaccatcacacacctcccattcatcttccttctgttcttaatattttggtgtggttcttctagatgccatctcactgtcttgcccaggctggtctcaaactcctggcctcaagtggtcttcccaccttggcctcctaaagtgctggaattatagacatgagccactgcacctggcctcatttaatttgttaatataataagtgatgttctggctgggtgccatggctcacacctgtaatcccaacactttgggaggctgaggtgggtggatcattcgaggtcaggagtttgagaccagcctggccaacatggtaaaaccctgtccctactaaaaatacaaaaattagccgggcttggtggcaggcacctgtagtcctagctactcgggagtctgaggcaggagaattgcttgaacccaggaggcagaggttgcagtgagccaagatcacaccactgcattccagcctgggcaacagagcaaaactccatctcaaaaaacaaaaaaagtgatgttcttaggtttctaaatgttatatcagccttcccaaggtggctgtcagcaggtgcctgctgcacattttgggaagttttaccttaggaagctggaggagtgtggtggggagaaggaggtgctattagtccagagcagaacccttcactggttgaggtgagaaggagggaagagtagggtggtcctgaaagagacctaattcaggagccagatacttccggaaccctgagagtgtctctcttgtatccacctagggaaggcattccttttaacctgagccctttaagtgcaggttggatatcagggttggcaaaggcagatgccatctgggaccttcctgaagagcaggttagcatattccaagctggaatatgctaaaagctttcaaaatacctattttctttaatccagaaatcctgcttctaacaatgtctcctgagaaaacgagaaacaaaatacacaaagccttagctctagggcttttcattgcaggttttactcatgagaaagaaagtgagaaacagatcatctgagtatccaagaatagggatttgttaaataatgacaattctaccccacatagaataggatagtctgtatctaccaggaattttgacacagagttacttttattgatgtgaagatattgctgatatagtcctaactaagacatatagcaaatggtcctgttttagtttgaagaaaaatgtgtgcatatgtgtgtgtctggtctataactttttttcttctctttaatttttggatctttttctgcaataaatatgaattacttgtgtaattatatgcaaaggaagatgttacattatgttcaatatgttttatttataagtcaggaaattgtagaatactagagcaatatctccatccaaagaagttaaaaatgatttttgggtgctccctggtgggatgacaagttttccggcacatttatgcgaaagcaggtgggtaggttagctgggagaatggaggtggtggtggcagcgaactcttagttcccaaagaggctgaaaacctcagtggcttttaagtagagcctgcctgcagcccactcttttctatttaaaattagattattgtgaaacatttcaccatatagatggaatgacctatttcaaagggtgcttaagctagattatattaaagaggctttaccatagtcaacagttattgagttgattatgctgtggtatggatgtcagtgttagaaaatcaatggtattctgtagaactttaaacatgtgaatatttgtgatttaatattcttctgtggggcaactaggagccttattgagataagtgggcagggctactcgagtcctcttgttgttccatgaaaaattatattcttactaaaaattggccgggtgtgttggctcacgcctgtaatcctagcactttgggagactgaggtgggtagatcacgaggtcaggagttcgagaccaccctgaccaacatgatgaaactctgtctgtactgaaaatacaaaattagccgggcgtggtggcacatgactgtaatcccagttacttgagagactgaagcaggagaatcgcttgaacccaggaggtggaggttgcaatgagctgaaatcgcaccattgcactctagcctgggcaacaagagtgaaactctgtctcaaaaaaaaaaaaaaaaaatctggtgaagattgggctgggccactgtggagttgctctcaatataaactttgtgcctctcatgcagtggtggtgtgactggcagtgccaagagtgacacttgattgcctggtcattagctcctgccctgggttgaattttagcatctcaccgtatctacgtctgtgaggcggtgagcctcacacctgagtctacgctgttttcctttgttacgaggtctcttcgtcaacttgggttgctgcaacaaagcaccatagactgggtacttattcagaatggaagtttattcctcacagttctagaagtccaagatcttttacagagtggaaatttatttctcacagttctggaggctggaagcccaggatcagggcgctagcatggtggggttctggcccgggccctcttccaggatgcagactgtagacttctctctgtgtccttacatggaggaaaaaggcacaagagagctcttgaggtcctttttataggacactaatcccattcatgaggactccaccctcgtgatctaatcaccccaccaaagccccacttcctgcgccattccactgggagctaggattttaacatttggtaatacttaattaatagatctacaaaatcaactatcagtgtatgtatccagcttggttctctctccatgactccacgctgctattcatctctacctgacgtcaccactgggttgtccagagacagtctcccacagtacactgaagtctgcgtgccatctgtccccacgcccgctctgtcccacatcctgtcgctctcatttgatggcaactgcatcctctcagctgctagggccgaaactctggggtcatcctggactctttttctattcaacctcacctccattctaacagcaaatcttcctttccagaatccaaattcgcctccccagctgctgcccccaccctggtgtgacaccatccttgcctgcctggccccacagtggtctcccatcagcccccttcctccaccccattcttctagagcctgtttcccacccagcagccagagtggatgcagatgattggcagccgatggctcaggacactccccctactcagggggtccccaggcccctgtccacggtctctgagacctcctgttgcctcctggacccgggttactcctcctcttctcactcactctgctctagccctgccggccaatgggctgctccctggatgcaccaggcacagtcctgagttggggcccttgcttgagctgtttcctctactggggcattttcccctctctgtgtccctgtggcccactgccttgcctctttcacacacggaccccaacatcacctctgccaagcccagcctgaccactctattccctagagagctgcacccgccctgcacacaccttttttaccccatcgccgtctgccgtgctctgtcgtttatttctctacgagccccatagttggtgtgtttccctccctggagaaagcacaccccaggagggctgagaccttagcagttcactgatgttttcacgtctaggccctcactcgagtcagtgctcaacacacatttgagaaggatcgagcggctggctcactctaaaccatctctgagaattgggactccaggtccctgtcattgccttgtccagccccctggagggtagtgggtgcccctcggggtccccagtgctgacccaccatgctccgactctgcccctctgacccgcttcccctcttcatttctagaccggccttattgtcgcctgctaccacggctttgtggataccgtggtggccttagcagagtgcccccacgttgacgtcaactggcaggacagcgaggggaacacagccctaatcacagctgcacaggcaggtaagagctggctttcccctttcctctcagagccgtggccagagcaccgccgccgggcagcccgggctcccgttgcgatgcagtcaggatggaaatgatcagagaccatgtcctgctaccaaggggtgccagggaagggctgattgctgtgaccacacgctatgcatttacccacttgttcagaattcagtatgggcagatcaagctccgatactgcccaaagtttttgaatatgaatctgtaccagaaagccacccttgtcaccgcttcacctgaagcctcacactccatcctgctcccgaagactgggggtggcacgaggctggcagacccaccagtggaagagacacaatcatgtgtctcagtgatagttaatcatgaaagtagacacgtgtagaaggtgactttgcacttcacctgtagagttaaagaaacgccaggaactgtttctgagagctgttagagtatccgtgtaacaagctgagatgaagtcagtgggagcatcttgtgagcgggtatccaagcatgtggccctcagcccatcagtcatcaagaagacagtgcttatgtcaatattgccaagtgcattgcgactctcctgctttggaactgtatccagacatttttttgaggacagacatgaaacctatgcttgcctcttcataatcacacttcatttggaacagtggtcttgaccaggtttatcactgacccctttcacatttctttgcctccaaagattctgtctgtttcatcggtcaagttctcagttgcaagcaaagaagctgcctgcagctgagccaggaagaacaggcgcttgtgtgttgaaggaaggaggggaagcttacacggttgtcgggttgttgagaatcccactcagggcctggaaactggaggaagtgcccccgaccacactgtatgttgattctggttgggaaatggctgttgctgtcaccaaaaggagacctccttgtcccttgttgcttcacaagctcctggaccaaagccaccctgggtggatctgatgggtggggggccagggaggctggaaaaccagtgtttgacagtttcatcccctgtggtgggagtggtctgggcaccctacttttcaatcaagacgaatagagtgggggaactcttcaaacttagaaagggccaggggctgtgctaacatgtgttcacctcctcaggtttcgaagcgtgaggcatcacttccatggagggttccaggctttgaaaacctagcaagagtgtgaaagggctttgtaaggcattcagtgattcgtttcctctcgtgggccagctgccatgtcagggaccaaggatacagaagtgcagggcagccccgtccttgagtaattctgcagctcatgggacagagaaacacacgaagcccagcaccatctgtctgccggagcttggtgctgtgggatgagaacactctatctagcctgaagttcatgataaggtcttgcaagaaggggatttgagctggggctgagagggagccgggcagttctcaggaatggcgagtcttagggacagtgtaggtgggcatggctgtaggatggcgtgtgtctaggagagatgagggaaggatggggaccagaccattaagggtctaagcccaatgcaagggaatgtatttcagtagcgtgaggctgcgtgagtggtgacaggggtgagaggatcccaggggcgtagcagagggctcagagcacagggaagggccgggagctgtgtggctagaaacacagttggcggtggtggtgatgcgggccatggaggagagctgggggtctaggatggctttgggctttgggacaggggataacaccaactgcaaagggcatataagtaaaagaagatgaatgggaggaacattggttttgagctggctatcatgactttgaaatgctctgagacctctaagtaaagaggtctccatggcaagtcaggaagagaaggagctccaaaatctggtccctgctagaaatacagatgagggacaggtgttgctggtgagagctgggacaaggattaggtcatgacaatatgagaatgtacgataagaggggatttcttttcttactgatctgccagagctctttgtgcgttagagataatagctgtgctttgatacccatgaggtgctttccagagtcttgcctgtttgcaggtgttttgattttatattcacccatgattgtttcttcagagtcaggagcacatcgtatatttttggcaagaatatggcattggccatgatatgtccttggtgtgtcctatcaggacacatactgccagtgtgtcctggtgtgggtgatgctaaatttgacgaactgcttacatttctccattttaaaggcagatatttcccctctgtaattagtaagtaatctgcaaggtgatacttagagattgtatgaatatcctgtttccccaccagtttttgccattgataatccttttctgaatcatttattttacacttattatctgatatttttctataaagaagagctttcctttagccccaccctttttttggtaccattactcattttttaaaaatctcgtgtgttctacttcaataacgcctttgttcttttcagtgctgaagttatcccaaacccagccagttggtaaccctgaagatggctccagtgtccttttgtcatatttctgtcagttttgagtattttcttgatttatggcacaccaaagtgttccacattctccctggactttcccagtccctgtctgtaaccagctgtatcttcaaggaatgatagttctttttttagtgaggaatggtatttagaaaccaaaatctggactctagctgtgctcattcacactaaatgttattgcttctaggcatttcagtgagcagagttagaaaaaaaaatatttaaaaaataaggatacctccaatccaaatgcaacaccatagtattcctcctcttcaccctttccatatgcttcccccattctttgtcggcaagaaacctggtttgcagcaatcacaatgcatttacccattttcctgtcctacgacaaatgtgcacaaagtggtgatactaaaggataattttcaaaagcttaaaaatttgactcttaggtggacagaaagtgaaaactcattaattagtgatgggctagtaattagttaaggccagttcaaaggaaatttgaagaacaggcacatagaggcaatcacaaatgctgaaatacatctgctaatagatgcaaaactggttaatatcctataaggcaatagaatataatgttgtgggttatcttttctataaggtgatgttatggactgaatgtttatgtcctccccctcaaattcatatgttaaaaccccaactcccaatgtgatgcattagaaggtggggatttggggaagtaattaagtttagatgagatcatgagagtagggccaccatgatgggattagtgtccttataagaagaggaagagaccagagctcgctccttccccaccatgtaaggacacagtgagaagacagctgcctgcaaacaggaggaggagcctccagaactgtgagaaataaatgtctattgtttaagccacctagtctatggtattttgtcatagcagcctgagctataacaggaagtaaattatatctctaccagatacaatgcaattgccttgctgtggacaatcagttttacagcttaacttctaaccttgtagagttgtggagcagcctaggaactgaatactgccagagggtcccctggacagcacccagaaccccacatccagcaccagcacttccctggagggaaaagagacccagtcacctcattagctcagtttccagctatgaacagtttttttttaaccaaagaatcagaaattagaataccaccactgctaccagcatcagacctaagtaaaagcccatatttctttgtggttgttttcttccaacatattctaccaaaagttattggtcttatagcaccatattcaaaaacgcggttaaatttttttaactttatgcagtctctccagatttcaaattgcttccctttccacaaatgcttatgtttttcactgagtcagtgacctattgaatttttctaagaatatggattgttaaaatttgaaaaatgttcttttgcttcttgcaataaaccaatttcattttttaaattgtttcctaggcactagacaaccggggagcaatcgatctatttcagatgaagatgctgccctgaaacctgtagcccagccccttctttttgaatctcactgtctttacagtgatccagggttgttttttgtttttgctttattttattttatttttttttttttctggcttgctcattcttctgcagggactgtgctcatccttctctggtttattttaagtcaaggatgacacaggtcctcttggagattggagggctctctggcaaaggaagaaggaaagggctccagctgatttccatccaggctcagtgcccagcagcctggggcgtggtgggaagaactcgggtccaggtgcaggccccgcagccactcccctcctgggctgtgtagttttacttccaagttgagtgtggcatgggagcctgtaacaaccaaggagcagcccccaccctttgcctggtgggacctcagggggaaggtggcctcgggagcttagtgccctccctggcctcatgtgcctggagtgttgaaaaatggcatcagtgggtctcaaagcgtccccatagaccacctctccttttctgcccttctatctgtggggcattgccggaattttgcagggttcactgaattaggtgtaataccccatcctcctcatcaacagaggcctgtccctgccatcttccttaaggaacagaaattgggtggtgtccctcgatggttctagtcacactcctggcttctctctgttgcctttggtcacagatggtgtcttcatctgcttaggctgtgataaaggaaataagcagctctctggggcctcttttgtgagggcactaatcccaccacgaggacccctccgtcaggacctaatcacctccgaaagccacctgctgtagtgtcatcctggaggcaggattttcgcacaggaatttcggaggacagaaacattcagactgtggcaggtgggaagctggataggagggaagattcctgtgttctcagctctcttgggagctggcccacccaggggtagccgtgctgccagacagagctggagtccaagtcaggtagcaggatcgggtggccggggtatgtaccagggtctgggctatcctgagggcagcatcacagctggaaacctgcctgggtggacaggaggaggcgggcagaggcctcagccattatcctgcttcctccacttggcctggctgatgttcttggaggctgattttaaaatacaatacacagtgtttggggggaaaatgaccccacatgagcaaggaaattagaggtgaatacctcttccacctcactgtcagccctctcttcagtctgctctctggagataactgttgttaatgatttgatgcctagatgggtttactctgccttttcaatttaaataaaatcattattataatgtattttttctttacttcttgttttctttcgttctttctttcttttctttttttttttttttttgagtctgagtcttgctctatcgcccaggctggggtgcagtggcacaatctcagctctctacaacctctgcttcccaggttcaagcgattctcttgcctcagcctcccgagtagctgagattataggcgccagtcaccgtgcccagctacttcttgtattttcagcagaggcggggtttcaccatgtaggccagactggttttgaactcctgacctcaagtgatccgcccaccttggcctcccaaagtgctggaattacaggcgtgagccgccgggcctggccttttttttcttttttactggcttttgttatcttcccctacttactgatttgcttgagctctctgtggccgccactgtgtgcacccaccctctggcctgggctctgatccctggacacccaacctaggctgctgcctgaggctttgggactgaattgttgaggttgcatacggaggcagaggggagagggactttacaccatttaaacaaacacagattaaaaagcttccttgtgtgtgtcttaattgcctcaatgtgccgaagagattttccctaatttctttctgaacctccaggggctgcccctgtccccatgggcatagtttccttagacactggctcccaatcttgcgcctccggcgtcagcatcacctgggctggctcatgtgagcattaacacagatctggtggaaacacagactgccaggccctgcccctggagtctttctttgaataggcctggggtggggcccaagaatgagcagatcaacaggtttcctggtgaggctgatgccactggcccagggaccccacattgaggatggagagctttgaagattttatgcctgatgacggcaaaggacccctctcagtgggcactgaagaccagcagagtcacagaccccacgagagatgttgtcagacagacacagaggcatcacggaattaaagtgaaaatgaggaaggcaggtgagcatgtgttcatgactttcctgtgctgttttgccaaagaggctgtttaggcccaatcaggtgatgtcccattttaatcaatttcataaccagttttatttctttgatgatttgttaatttcaaaagctgtccatgcatatttgcttacagccaaaaatgactacaaaagtattatcagggaggaagaaaaagatcccttctctgtcttccaaatattccagctcccttatcagcactcaggagtcacctcttcagacctcattcagtcctttccaaacacacacgtatgtatgtgcgctttgtattcacatgactgggctagtgctgttgagactgtgtttttagtggttttgttcacatggttattaatctagaagctcctgctgtgtcggtgtccctgagccctgccaggcgctcgtagccctgccttcctgcacggggatgtgtggctcatgcccggttccccaccaagacttcaaatttgagaggctgcgttatgactggccttcactcactgtggtggacccggctcttaggccagtccttgaacatgaagtacttgcttcttaaatatttgttggaaaagaggatattgtgtaaaatgcatgaaccgtggtatacttaactgtcccagttactggacaggtgggcttttgagttaatcaacggcagcaaggctgtagtgaagtctttggatctggggtgcatctctgaggacagcgtgttaggatcctggcagcttgaagcatgttgagtgacaggtggtctcagagggctgaacagaggagttgatgagggcctgtcaattacggggggaagggtagagttaagggaaccaacattgaaaggattaaggggagggactctgcagagagtgacccaggccaagaagctggaacccgagaggcagcctcggcctagaacccgagtgacacaggccaagaagctggaacccgagaggcagcctcggcctagaaccgcagccaggggccggagtgggaggcagggccagatgtcccgctccttccaccctggtcccctgctgagccaacccagaaacctcattggggcggaaactgggcaggtgctgttggtgcaggtcagcttcctaggccgaaagcagggcaaggaagaggagaagcaatgtgcagacacactcttagaacagaattgcttcagcaagggctgtgcctgttttaagtgtatgcagctgccaagtggtctttagaaagctgtggcgatttctcctttcccctgagtgtccaagagtgttcttgcaagccctggctgagatcagtcttttcagtatttccctactcaaatgaaccaaaactctggttttcagttgtatttccccagctctcttttgagcctagtacctgttaggatgcttttggcttcaaccacaaggacactgccttctcttgcaacacaagacatctgcgggcgatgttgcagggttgcttcactgagtagctgggtgatgctgggacctagagccacttctcagaaatacattcgccttttccttcatggtcccaaggtggccccagctgctagaagtgccacggcttcacgttgcaacactcagggacatcaaggaagaggagcaaatccctgtcggcgtttccctttataagacaggaaaacatttccagaaggctccagcagagtatcgttgccatctcaccaaccagggttgcgtcacaagcccgtgccaaaccagtgatggaggatggcttgtgtagacagcagtcgcactaagcagaatcagcattgtgaagcgcaatcttaaagcaaccatatgtttatattatttgctatggcaactgggttggttgtctgagagttggaagctctgggtttctggaggacacagcatttatgagtacgaattcggatgcaaatgccttcatctgccttttgagtgttctctaaaaagtctaatttcctcggctatttaatgcacaataaaaatacagccaaatctgtactaggtctgtaaatggagagaacgtttgaaaataaatccccatgtaatccctaagtctcatttagccagtcatttcaactttcaccaccgctccactaacaaaaataaaataagataaccaaagaaaggaacaagaagtcccatggatagagttgtgtgtttatttctgtttccttgttgtgctttaacagaatagcatggacgtggtaaagtgaggaaacgccaggggtctctttgagctggtgatgggatacagcacgtgaagcttgttttgggtataaggaacctctgatgtgtgcttgcaacttgttatttcttgcatttaattgtaaaattctgaggctacgtgctgagagccagcctggcaggatgctgcccggggacggggacagaacgggagggattctcaggggcagctgtgggtttgggctgcgggggagccctggttcctgagctgaatcggggagagtcccagttcagaggagaatttatgacttggtcagaacccaggaacaatgcctcttcatgttatttatcttattttattagcagtgcacacgatcacgatcttagtgtgatctcattgtgatgttcatgttgttttgaagtgcttccttttttctcagtttataccgtttcaaataagagagtagaacttggtgagtctcggtttcccagcgttgccttatcttttcctgtgagcttttctgagctcttctgattggccatggcagcgccacacccctgcccgctggccagccaggagggctcctcagccagcttggggcttgcctggctcctccttcagacccctgcctgccctgcaaagagcagggatgctgccctcccctactaaccctgcccctccatctgcatggtaaatgccttatgctaagaattcctggagtctgttcatgccgcgtggctggtatgatgtcatatttccaaagccgacagctccctctactggcctggtctggagaactgcagtttgagtgccttgagtcagtcaatcttagacaacccaattctgtaacattttccaatttttagagcagtttgtgtttattgcctgttttttttagatggagttttgctcttgttgcccaggctggagtgcaatgatgtgatcttggctcactgcaatctccgcctcccgggttcaagtgattctcctgcctcagcctcctgagtagctgggattacaggtgcctgccactacgcccagccaattttttgtatttttagtagagacggggtttcaccatgttggccaggctggtatcgaactcctgatctcaggtcatccacccacttcggcctcccaaagtgctgggattacaggcgtgaaccattgcgctcggccagcccagctaatttttattttttgagatgggatcttgccatgttgcccaggcttgtatctaactcctaagctcaagtgatcctctagcctcagcctccctggcctcttcgggccttggcctctctgctgggattacaggcacgagccaccttgcccaccctgatactttcaataaataaacttttcccaaaggagtggtaggaatgtttcagccttttcatctaatgcatatttattgagcaccccagagcatgcagtcagttggaagttttaagcatgtgagctgggtaacgagggctgtggcggctgtgggaacccatatatgcatgggaacgtggacgatgagacaccgtgggtcaaggggcaccagggaagacctggagttggaagggatggctcatcaggtcaccaagtaaaaagaggaggcagaatattccaggtagagggactccttgtgcagaggccactagattagaggaagtgtggctcatgagtgaattacacggaatgctggctgtttgaccataaagtggattgggagggcattggcggtgagagctgagggtgaagaggtaaaaaccagctcattgaagagttgagacctcatctaaagagcagagcccatggagagtttcggatgagtagtggggatggtcagaggcccctgttggtgtcaccgtgctgctggtgtggagaatgaatgggggcagaagtgggacaaaggaggctagtcaggacaggagctgtggccccatggggacgtggtagcccaggtcagggatggagaaacaaagacagttttaggaaatttaaacttttttttgtagagatgaggtcttgccatgctgcctatgctggtctcaaattcccgtgctcaagtgatgtcagaggtgcagttggcagaatgtggtgattgcttgggtgagggaggatgtggagggcttgagactgagtccagccgtctggcttgggtgatggggtgactggtggtgttcatcactgaataagggatgtgggagaggagtagcttcggaggaaagatgttttgggtttgatgcattgagtttgtaggatacccatgatgaaatactcagtagacagatactcaggtaaaaaactgaagaaaagagatagaactggaaagagttgatgtggaagctttagagctgaaacttggatccacaggagtgtataggatcaccaaaggagagtgtatgagataaggagggggcttagcaggcagctgaggaacagcagcatttcaggaaggagagaacaggagctcagaatgttgagagggcggaaaatcagaagggtgagcatctgcatgtccatggaaagagcgtgtttcagaaaggatgaaagagaggagtgagtgggaaatgctggggagatgttgaatgtgatgagaactgacaaatcaccactgagtctcattgtaagaaggtcactggggactgctgggggtggtttcagcaaagtcagagagtgtcattagcaacagtgagagtagatggatctggaattggactgaagcggagttgaatggttgatggagggtggcgggaacatgaagacggcccacaggggttgctgtgagtcacatatgcttttaagatgagagacccttgagcatgcatgtcagctagttattgctgtgtaacaaacaactcccatgctctgggatgtttttattgcttatgcatctgtggatgggctggggatctgttgatctaaactgtccttgctcaagtctgtgggcaagtcggggacctgttcttgggcacttcggctggggcagctctgctgcatgcattactcatcctcttcctgggagcagcgagccagcctgggcatgctcttcttggggagacagctgaggcacaaacatgcatgaaagtctggataagtacatttcaaccttctgcttccatcacgcctgcaaacatcccatcggccaaggttccactagacagagaactgggaagtcacttaacaaagggcagtgtgaagaagatgggccattagtgcattgtaggaactaagggccttctgaaggttcactaaaatcaacttgcaaaaggcaggtgaataagagaagaggcatacaaaagaggccatgttcccataacatgcgtacatgggagccttcggaatgaaaacccaaaaatgcaggaggaattttccatttttctgcttaggttcaacaaagtgtggacagttatgtagaaatatagttggacaggccaggcacggtggctcatgcctagaatcccagcactttgggaggctgaggcaggagaatggcttgaacccaggaggctgaggttgcagtgagccaaggtcgcgccactgcactccagcctaggtgacagagtgagactgtgtcaaaaaaaaaaaaaaaagaagaagaaatataatgctaataaatagactgagtggggaaaccccacaggcctgcctgtctcctcgattcttctaggtttctctgagcagcacttcttccttctgggagtgactctccctggaacaggggtcttatgacctacagtcggacatggcaagtcagataatttctttatgttagggcagtatttttaggttttagggaacctttaggctggccttagggaaaaggggttctggtttcaaagatctgccttggggaagagggattccagtttggatggctggcctcagggaagaagggactgagacatgggagggcaggagggcagagagaaacctttgcttctgaggccttcactgtggggtattgctttctgagccccaacagcattctgagggaagtgggtctgcaaggaatgagaggttgatgagaaacaggagggatctgataaatattccacagcagtgggcagggagtggctgtcaagcacaggaggggaggagcagggataagcctccttcagcaagaggagaatcccctgcgttttcaataggaaaagtgaactgaggattgacgaggttcataaacttggaaagaagagctttcttctcataaagggttgcagcctgcagggtggctattgtggcagggaagcagcgcctctggccagaagccagaaacagacccttccaggggcagaagaacaagacagaagaacaatgcatgctgaaggaggtggctcaatacacatattccataagctatgggagaagcattgaatatcgatgagaggagaaacacgcaagtgtgcaatcgagctccgtgcctctccctgggacctgtgttcaaaaagcaacagcgttagcatgatctgagggtggagttttcaggccctgacctcaaaaggtgaagcagaggacatgaaaaccctcactgcgcgtcctctgtggacctgccggacgcactccaaagccatggccagtgtctctcatgaggacggaatgctggtcggttgtttcatccaaattgcagaacggcggggcagcatcaggcggttggtttatatcagtggaggagtctttagaacgggctggtttctgtttagacttaggaaagaaagcctcacggttagcaaggaatgggtataacgaggcgcattgcccttccatcctgtcatagccaggactcagttttcaagggttctctggggtccccttgggcaggagggggtcggttcagtccgttggatggctcaggatttcacttttccttctcggaggcccgtgaatgtgggcagcgtggggggcgatgggggaaagccgagggacttcccttctggtggtttctgttccctctatgaacttgaagatgagtcatccaggagaggggtttgcgtgaggtcggtgacttccatgtgaaaaatttaacattttccccatggggcctggggaagagtcaaccgggaagcacaggagcactgctggggcaggctgagaagccggtcgggcccgggtggcgtgggtgtccacctctttgtgtcccccaacgaaggcaccttcgcatccatgcagagcggaaccaggggtgtggcggggccaggcgtcatttccagctttcctcttttgcataccacagacctgtccatccactcatttaggagctctctgaatcaagcactcctctccctcctcctgcccggggttgggggctgggctccatctctgcctcctgaatgctcccgtggcttcctggtgagctccccaccactgggagagcctcaggtccagggtggagaggccccacaccaggccgcacagccagctgtgaatcatggtcctgaccttgcactctttttgaacggctctatgctagtttccccttttttatttttatttttatttatgtatttattttgagacagtgtcttgctctgttgcccaggctggagtacagtggcatgatctctgctcactgcaacctcctcctcctggtttcaagtgattctcctgcctcagcctcccgagtagctgggattacaggcacccgccaccactcccagctaatttttctatttttagtagagatggggtttccccatgttggccaggctggtcttgaactcctgacctcaggtgatccacccccctcagcctcccaaagtgctaggattacaggcgtgagccaccatgcccagccagttctcctctttttttttttttttttctttttgagatggggtcttgctctgtcaccaggctggagtgcagtgatgcaatcttggctcaccgcaacctccacctcctgggttcaagcaattctcctgcctcagcctccggagtaactgggactacaggtgcacgccaccacgcccagctaatttttatatttttagtagagatggggtttcaccatgttggccaggacggtgtgatctcttggccacgtgatccacccgcctcggcctcccagagtgctgggattacaggcgtgcgccactgcgccaagcctatctcctctttttttaaaataaacttttgatttgagaatagtttatgtttacagagaaaccacaaacactgtacagagaatgcctgtgtgcctcacactggttccctctgttgttaagatctgacgtccgtgacgcgctgaacacaatgaatggacgcgtgtcaattcaccattattaactgaagtccgttctttattcggatttcctcagcgtttcccggatttcctttttctgttgcaggatcgcatgtggcatttagcactcatggctcctcaggctcctcttggctgtgagcttctcagacttctcttgtttttcatgacctcgacagttttgaggaggactggtcaggtacattgcagaatgttccttaatttggacgtgcctgatgcttttcttgtgatgagactggagttatgagtttttggaggaagacgcccgataaagggctgatgggccttggtcacctggctgaggtcatgttagcagatttctccactgtgaggttctctccctcctcccccgtttccgtgtaatagtctttcacaggaagtcagtgcacgcagcccgcgggttaaggaggggggaacacgttctagccccttgagagtggagtgcctgcctggattattcagaatttttcttccagatttttctattctgctgggcaccttttacacacagattgtctcctataattttcacaaatgggaggttgatattatccctcattttacagatatggaaaagctgacttccaaaagacacccggattctgagtggcaggcctgggccttgaacctggctgttctcagagccagctctcttcagtactgagctcattgtctacactatgttccagtgacgcgatttcattcaaattcacttcctccctgggtcacttgtgaccctctcttaagcagggtagggcttattggtggagagggggtgttctggggttctctaggtgaacctaccctttaaaagggcttctctgaggatttcaggaaccaagtccgattccataatgtccaagttggactgggctcaaactagatttttttcttttttttttttgagacagggtctcactctgtcgtccaggctggagttcagtggtgtgatcttagctcactgcaacctccacctcctgggttcaagcaatgctcctgcctcaacctcctgagtagctgagaatataggcatgcaccagcacacccagctaatttttgtatttttagtagagacaggcactatgttgcccaggccggtcttgaactcctggcctcaagtgatctgcctgccttggcctcccaaagtgctgggattacaggagtgagccactgcacctggcctcaaactagatttcaatatggcgtgtgtttgggttcccttgtgcaaggaaggctgtgtgtctcatatatgtaaagaaaaggaaagctccttttggttactcatcatggtttttaaagaagaaaggttaatacttatacattcttagaagtattgggtccacctttgatttccattgaatggggtcatctgtgtgatgagaggtattattctgccatcctgggaaaacccgtgggaagcagggcgtgatttcttggatcatcgaaagctcaggcctgtagtcagaacaagttgactgcatgttggtttttctggactcaacataatacgcagaacagatctatataatgggtggtttgctctgtggactttgagtttttcctctttccacctgttcaaagtgctgaggatatatcagtgcaaaggaacatcctgcagaagattgtgacggacacgctatttcacagtttaaagaaatggctccaaaggaattgcaattcattttactatgcccctggttaaatctaactgacaggtgccgccaagcatttaactggaccataaaccaaactgagatcaaaggattcccccaccttcccataccacccagttgagagtaattcagcagctctgggtacctgacagctggccttagcccctccccgcacatagtaaaggacgagggagagcaatgtggtgtaaatgagtcaaaaaagcaccagcgactggctgtgagtcacgcagcgaggggatcgtaccctttgtttcctgcttataacctgaacactgttagactcatcagggcttccttttcaaaaagatacatggttccccttttcacatttgtggagagctcaggagatgggctgaggtcaatggcgagcttgctcctcaggagagttcacccctgattttggttgcctgttccttcttcttttggattgatgaagagcaaacccacaggatttcatactggtgaggcagcagcctggagtggccctcaaaggaggaaactgggttccaaccccggcagtactatccctcagggtgtggctggggagacagaagccacttgatatatcggagggtttcatattggatttgctgaactgaaggggctaggggagcagaggccaagggcgcccagccctgcctactggagatctcagccgcagcggggaatcctggaggctgctgcagcgtcatgctcacgtagtattctgtctgcagaggtgggctgggctggggaggcacctcaggtctcatgcctgcccgaccccagagtgatgtccttgccacctctctcccatcccaaatctcaggcagtgccacccattggaagtttctgtgcaaaccagatgcctgtggagattctgggcccagggcccggcttctccatgattcaggtgttcctggggggagggaggtgatgccaagttaaggagagagtgcatagaaatgtccacgaggcccctgcagctgcgacagtgggggctgaaaggaacatgcttgagttggaatgaataagtggggatttctgagcactgcgtcatcggtgcataagaatggggactgtggccagacacagtggctcacacctggaatcccagcactttgggaggctgaggcaggagaactgcttgaatgcaggagtttgagaccagcctcggcaacgttgggagatcccatctctacaaaaaaaaattttttttaattagctgggcatgatgatgctcgcctgtgagcccagctacttgggaggctgaggagggaggatctcttgagcccaggaggtccacactacagtgagctatgatcgtgctcctgcactccagtgtgagtgacaaagagagactccatctcttaaataaacaaaaaggatgggaactgggtacccagcacctcccctggggttcaggaggagagactcgggcagattgctcatattcccaagagtttcagacctcatcagcaggggcctggatggaggtggcagctcaggggagggtgcagcagagggagagaggaaggaagctctttccaccaggtgtggttggtcacgaaggagtgaagtctgagcttcggggacagtggttctcacctggggtgttcttgccccaccgatggcggtttggtggtgtctggacacagttttggttgtcacaacctatgcgggagtgggggtggttgctactggcatctatcgggtagagaccagggatctgcctagtgtcctgcagtgcacagggcagtccccacaaccaagagtcatgcggccccctgtgccgactgtgccaaggctgggacggaccctgctccaggacactgaagtgggggagggggagatgtattcacacaaggacttatgagctagccggcatcaggtggcatggacagttgacccaagaggatgctctcccactccattttggttttccatgggagaatcctggaaacagcactgttgctgtgacattctccttattcaccattaactgagagcaccatgggcgtgcctgggaatgagcagaaagttagatcctttttggaggtgcaaggtgagaaaggggagaaatctgtgttctctgagacatctccttacctgctttgctttatagctgagggccttgcctgcgacactctgtgggatgtgtgtgggcgtaggtagttagacacacacacacacacacacacacacacacacacacacggcggcggggggaggggtggtggtgggtaagggtggagagagagactcctgcttctgggtgggaacagggtgccagcgtgaattggcactgtcctattgctatgatgatgactttttcctccctgcagctctggagcacttggaagcggttctgaagctcatttgcagctttgcatctgtttgcacgggcgtctcctgctgggagttgaggcttcctgccctcattggctgtctgaggctgcgctccctacctgcccgcagcgtccctgccccccacatccacccccagtagtgtaatgggacagctcctccctcgagtgctttgccgaaggggacctgcaagaacccaaaacagcagcgctgcagccagggcggtgccttctcctttcctctgtttcctgggctccaggagaattctgtcttggggtccgagaaaaactcacacagcagaccggctggcccagggctgactcagtgtttctttctctctctaggaaggcctggctggaaccagcacattttgtggaagtgggaaccaatacacgtgtacacttctctttacagggcacgctatcatcactaactacttgttgaactatttccctggtcttgaccttgaaaggaggaacgcgttcgggttcaccgccctgatgaaagccgccatgcagggtcgaacggactgcatccgagccctgatgctagcaggtatgtccacctgtcctgtgcagcttccaggggccctgggacaccagagttgctcctttatggaatatgttttgagattaatcactcccatagaaacaatgcctagttgctgcaataaataatagtttcttcactgacatatacttctgtaactatctgaggttttaaaaaagccacagcattggttcccttcaggacacccctttctgctccctgctgagctttgcagtgggtggcaccttccctcacctgctgttttcctcctgcccacccgttctacaccccaagtcctgtccatatctgttcctcctcagaaaggggtgatcccttggctgtaaatggcaagactgtgctgttgaaggtgggcgtagggatggtgggaacggcccaggccatcctaggtcactgcttgctggtgggtggcattgcatagtaacgttaggaggtgatgtggagttgcatgttaatgttgggatgtgatgtggagttgcatggtaacgttgggaggtgacgtggagttgcatggtgacgttaggaggtgacgtgttgcatggtaacgttagaaggcgatgtggagttgcttgttaacgttaggaggcgacatgttgcacggtagcattaggaagtaacatggagttgcagggtaatgttaggaggtgatccggagttacatggtaacattaagaggcaatgtggagttgcatggtaatgttagcgggtgacgtggagttgtgtggtaatgttagcgggtgacgcggagttgcgcggcgatattagcgggtgacgcggagttgcacggcgatgttagcgggtgacgcggagttgcgcggcgatgttaggcggtgacgcggagttgcgcggcgatgttagcgggtgacgcggagttgcgcggcgatgttagcgggtgacgcggagttgcgcggcgatgttaggcggtgacgcggagttgcgcggcgatgttagcgggtgacgcggagttgcgcggcgatgttagcgggtgacgcggcgttgcgcggcgatgttaggcggtgacgtggagttgcgcggcgatgttagcgggtgacgtggggttgcgcggcgatgttaggcggtgacgtggagttgcgcggcgatgttagcgggtgacgcggagttgcgcggcgatgttagcgggtgacgtggggttgcgcggcgatgttaggcggtgacgcggagttgcgcggcgatgttagcgggtgacgcggagttgcgcggcgatgttagcgggtgacgcggggttgcgcggcgatgttaggcggtgacgcggagttgcgcggcgatgttagcgggtgacgcggagttgcgcggcgatgttagcgggtgacgcggcgttgcgcggcgatgttaggcggtgacgtggagttgcgcggcgatgttaggcggtgacgtggagttgcgcggcgatgttagcgggtgacgcggagttgcgcggcgatgttagcgggtgacgcggagttgcgcggcgatgttagcgggtgacgtggggttgcgcggcgatgttaggcggtgacgcggagttgcgcggcgatgttagcgggtgacgcggagttgcgcggcgatgttagcgggtgacgtggggttgcgcggcgatgttaggcggtgacgcggagttgcgcggcgatgttagcgggtgacgcggagttgcgcggcgatgttagcgggtgacgcggcgttgcgcggcgatgttaggcggtgacgtggagttgtgcggcgatgttagcgggtgacgtggggttgcgcggcgatgttaggcggtgacgtggagttgcgcggtgatgttagcgggtgacgcggagttgcgcggcgatgttagcgggtgacgtggagttgcgcggcgatgttagcgggtgacgtggagttgcacggtgatgttaggcggtgacgtggagttgcgtggtaatgttagcgggtgacgtggagttgcgcggtgatgttagcgggtgacgtggagttgtgtggtgatgttagcgggtgatgtggagttgcgtggtaatgttaggaggcaacgtggtattgcatggtgatgtgtgtggcaatttccgttttctatgctgtgtcatagagtggaaaattctcaggctatcaacctggatcaacccctctttgtcttttgcgccatcttggagaacgcactttcctgttcccatctgtgaaatgggagtaatgacctctttctccctcacctccctgaggctaaaatgcaacaatactttatacactcctagaggctatccagcttcaatgagctactaagctaaatgccacacaactaatagctttaactcttttcttcactctgaaatagaatcaatgatcatccttcgtgcaacctcatcgggttattttgagaattaaatgagaaaatatgtgtcaagcacatgtcgtgttagattcagttagcagctgacatctcagtgaatgtgcgatgctgctttcaccattacttaattctgttattttaatttctctttatttttgttcttggcactgggttcagccagtcctgcttggcgctgcaagttcctgaagaagtggatttcctctctgtcttagttgttctgctgctataacaaaatacctcacctgtgtaatttgtaactgtagaaatttattgctcacacttggggaggctgagaagtccaagatcaaggtgccggcaggttcgatgtctgctgatgccccttccttcttactgtctcctctcatggcagaggggacaccgaggtaccctcaaaccctctttcataaggcactagtttgattcaggagggcacagccctcatgatctaatcaccccctaaaggcctcacctcttaatactattccagtgggtctgaagttccagcataggaattttggagggtcgtcaacattcagaccacagcaccacccctgtcttggttatcctgagggtggcatcagagttttcccaggcatcagtgcttccattaatgtcacttttctgttccaggacccctgctgggctcccacatttagttgtcttcttcttagttgtccccagtcttcttcttcttcttctttttttttttttttttttttttgagacagtctcactctgtcgcccaggctggagtgcggtggtgcaatctcggctcactgcaacctccacctcccgggttcaagcgattctcctgcctcagcctcccgagtagctgggattacaggcacctgccaccacgcacagctaatttttgtatttttagtagagacggtgtttcaccatgttggccaggttggtcttgaactcctgacatcccgtgatctgcccgccttagcctcccaaagttctgggattataggtgtgagccaccgcgccctgcccctcatcttcttgggtctgtgaagtttctgtcataacctgttgcccatgacgggacagtcttgattccaaccagtgtgcagcaccgcccagtctgagcccgtctgttgtttttctcgagatcaatctggagttacaggattcacaattgcttcagatttatctttctttttgctttaaccttaggggattctttagtcttaggagatgctataataaaaataagttcagtgaatgagaatagaggcttcaaagatgaaaactttcttggaaataaaaaaaaaaacataattaaaaacgagtcctatcgattgtacttttgattcagagatgatagttttattttaaaaaaacgagatatcagtttcaacagagtttcggccctgcctgccctcatcaatgagaaatggttcctactaattaaatggtaattatgtgatgcttttgtgtttggcgggagcttcagacacttttactatttctggatctagttataattgggcgtagatgtttggtaattgactttttcaactgaacatttatgatgtcagtcacatcactgcactttcccattgaattaatttgaactgcaaaccttttttaggtcagttgccctctaatcgctccgtttgactgccgtgctttcttccctgggtctcctgggggtttcaggcatgtgtgacagcatttagaggattccagaaacaccttgcacatctcttggaacgatgagtctgcgggcagtgggtttactgctgacattgctcttcccccatcagttatttggatacaaatttgacattagatttgagactctccctcccctattctccactttgcaagcccatcccccatcacagtctagaacaatccacggattattgtctgtgggatcctctagtgagtctctccctgtcctatacgaggtacagagcaggagctgaacagaaacagtccaggaaccaggacccagtttcaaattcatcttctccacttcccatctctacacctgcagcctgtcactcacctctctgggccccagtttcctcttctataaaatgaggctaatgatagcacccaccgcaggaaggtgggatgcggattgggcacgttcacaacagaacagccctcgggtgcatgctgggcttggagaagccttcggacatgttggttgtgattattgttattattatgattattggtgagtttatgtgttcaatagttatctgttaagtgaatgaaaaaatacggtttgtttttccctttgagaaatatcttgtaaatgagatacttaaactttcttaatgagggtagtaagcccctacctcagggtttttgttttttgcttttttgttctgtttttgtttgtttgttttgctttgttttgttttgttttgagacggagtctcactctgtcgcccagagtggagtgcagtggcgcgatctcggttcactgcaatctctgcctcctgggttcaagcaattctcttgcttcagcctcctgagtagctaggactacaggcatgcaccaccacatccagctaatgtttgtatttttaggagagacagggtttctccatattggccaggctggtctcaaactcctgaccttgtgatctgcatgcctcgtcctcccaaagtgctgggattacaggtgtgagccaccgcacctggccaggggtttcttaatttcagcactactaacatgcagagccagataattctttgttgtgggggctgtctttcaaattgtaggatttttagtggcatccctggcctctacccacaagatgactgtagcacctcttcagttgtgacaaccaaaaatgtctctagatgttgctcaaagtctcccaggttgggggaaaaattgcttcccatcgagaaccactgatataaataatttaaatgggaaaggatatacaaagtgagaagagacattttcccctctgtgtactcttcctcgcttgttctgtattcctccctcaaataaaagtgtgacatcttggccgggcatggtggcccacgtctgtaatctcagcactgtgggaggctgaggcgggtggatcacctgaggacaggagttcgagaccagcctggccaacatggtgaaatcccgcctctactgaaaatacaaaaaaaatttagccgggcatggtagcacaagcctgtaatcccagccactcgggaggctgaggcaagagaatcgcttgaacctaggaggcggaggttgcagtgagccgatatcatgccactgtattccagcctaggcaacagagtgagactctgtctcaaaaaaaaaaaaaaaaaaaaaagagaagtgacatcttgtttagggaacttttgagctgccctcttaagctttggttgtagtgtagaacttacggaatattttcatcttctactattactactaagcttacagttctcccaagaaaagtgggttttattttcctttgacagtagatgggtaagaattaaaaaaaaaaaaaaaagtgttgaattgcttccccaggattagtggagagcaataaggacagatgttgatatatttctaaaattcacacaaatattttaagtcttattctttccatttaaatacgtgatattaagaaaaaaataaaccatttaaagaaactaatagccagagcctttcttttagattgacacttcagattgtaataaaaagtataaccgggttctgagaggctgatcgattgcatctttggtttggcttcgtaaggagtaatgcaggctctgctgaagagcatcacaagggagttgcagaaccttgttaattcactgaaatattaatgcccacagtgacaggtctatttaaataggtggctctgagaagcgtatcgaggatgtgatttttttctgaagagaggcagaatctgtggaggttgccaggttccaggcttgcttaagggagctcactttcagacctgaagtgtggtgtaactgccgcagccttcaggaagcaaaaacaagcagcaataacctcaaatcttcctgtgattccaaggcgcaaagtggatttaaaggacggcgaggaacagagatcagagatgctcccgctgtgggtcagagggttgctcttgtctcagggaagccctgatatctctttctggaaagtcagatgatttccaaccatatagaggtttctttctgtttataaggaaaacttaaatttcctatgaagtgtgaatttgccatgtagaattgtttgaagtcattagccagagaaaggatgaaaagtcaagcattctgtgtcacctgcaaagcaaacctcgagacaaggacttgggggcaagtagttttgagggatggtggccccaggaagtggagtgagggggcagcaagtgagattgggaagaatggaagctaagaaatgtccaccaatgagcaggttcctcttgtgggcagctgggactcagaccccctggaccctccactatgaggaaaagatatcgcagagatgctgggaagtttatttcccaactccagtgcctctttgaggggagatgagaactttgagcacacttcccacctgctatgtggtgggggtggcttgtcctccctgctgggctggagcacaagctctttcttggaccctgcatccagatttgtcatcccgattatacccacaatgcccaagatacaggctggaggtggcacaaggggaggcagtgagggctggtccacagtggtctcctgtggccaggaaaggccccctggcaagagggagacctgagctagggtttgtagagtggataacatgggggtgggtgggggctggtggagaagcaggaaaggaagtgacacattcagggcttcacgctccacccacctcctgctagtcctgggcctggccatggctcccagagaaagccttcttgagaatgagtgatggaaagtatagatttttttttcccattagcacctgtttggaatgtttttggctgcaagtaacagaaatcctgactagacagtggcttaaagaaaacaggccgcatttctcagctccctggaagtctgaggttggcagtcaccctccagagctggccctggattccatgaggacaacagtggtttcctcctgtccatttggctccccttagcctgttgatctgtcaccccttgattccacgagaatcacccaatatgtgtttcagacaggaagctgcagcagcaccaaccatgctggtccctttcgtcaggaggcagaaccctctttagggctcagtcaccagtgctgggttgcttggctacttttagctgtaagggaggctggaagaatggggaacaggattgcagccgttagattccaatagtgattctcagctggaggtaatgttgccccaggggacatttggccacgtctgtagacatttttggttgtcagaactggcggactgctactggcatctagaagaaggtagagatcagggatgccgttaaatgttctccaatgcacaggacagcccacaccaaataattacctggcctaatatgtcaacagtgctgaggttcagaagtcctgggttagactgatcgtgatgcattgccaagaactgaggatgttgctgcctcaagtgaaatagaggattttgtgtagacttagagcactcaacaaggcagcgagtggacccatgggtggcagctccacttttgtccacatgattgagccctgggcaaaacaacactgggtgggagatgacgatgctggggggtctgctggcgagaagatggatacagtggcatttcagaaatcctctgtattctctggaaggtatttgtataaaatgttaataatcggtacttatcttttataatttaattgctgtgttcatgtcattaatataaccctttacagttgcttcctaaggcagcagatccctaatttatagcatgactctgattctagggctcagtggcctttgttccttagaatgtttgtattttctgagatcattttgaaaagataggtgaacatcaggacgaagagtgcaaaactttggacagatcttcctctggttttccattagcatttgaaaaatgtctctttcaggcagtgttcattaagattttaattttatagtttgttccttttttaagtgacatgcaattaattaaggtttaatgtgtcatctattttttgcaatgacacttttactgcccccttttcattttagtcagtttataaattgtactctagctaatgagttccatcctgatatccagttccaaataattaccactcttctaatatggctattctttaatgtgtcacagaactaagatccttaccaggcaagctcaggtgagctgggtctgccagagccatgaggccactgtgggccaacaggccagggcagtggctggggacccgaccttcctcagttcagcacacgttgatcagccatcacatgtcagactcctgggtctgcatgggatataaatgaagaagcgtctgtcgggtccggtcccctttgagctcacagactagataattgccctagttctccatgttgctttgctggtggagatatgactaatgggacttgaaatcctcaatgatttttttttttttgaaatggagtctttctctgttaatcaggctggagtgcggtggtgcgatctcggctcactgcaacctctgcctcccgggttgaagcgattctcctgcctcagcctcctgagtagttgggattacaggtgcctgccaccacgcccagctaattttttgtgtgtttttagtagaggtggggtttcaccatgtattggccaggttggtcccaaacccctgacgtcaggagatctgccctcctcggcctccaaagtgctaggattacaggtgtgagccactatgcctggcccctcaatgatttttaacagtatgtgggactgagattggaccaagattaattgaacagcaattccgtattaatttctatactacaacattgaaatttatgcagatttcatcaagttgagttgaagtttaactttgcaatatttgggggcagtgggtggactggggagatttattaagggagtgactagtgtcagggagactgtgtaaggggacctatcagtcaaccaataggatgtggatatcaagagatttattttaaggaattggctgtgtggtttggggggttggtgagtctgaaactggtgcggtaggctcgaaggctggaaactcaggcagcagtaagtagatgccgcagtcttgaggtggaatttctttgtttccaggaaaccttggtctttgctcttaatgccctcaactaattgggcgaggcccacccgcattatgaagggtaatctccttgacttagagtcaactgattatagatgttaaccacagctgcaaaatacctttggggcaacacttagatccatgtttgattaaatcactgggtattctagcctagccaagttgacatagaaaactaaaactgaccatcacaccaggactgccaggtggtaggaagtacattagactgaggttaggacacccaagtcttagaccctctctctgttactagcccacagccactgtgactgccattctttttgcaacaagccttttaaaaattcatgccccctacccaccaggatgaaacgtgttgagcaaacaaaaatgaatttttctatcctggaaaagcccaccatcggttaaaggtagacagaccccagccagctaggccgcagtgggagaagcgaaggaaccacccatttcccacagtccaggacccatggcagtcctcaagagtgagaccacagctggggtgccaccactttgcaagtgactgttactggtcatatttttagaactttctagccacagcattcaagtatgcaaggcagctttgttgtctggtcatctctccattgatggaaagctataggatcttatttctttaaaaaattctgtaatttggccaggcgcagtggctcacgcctgtaatcccagcactttgggaggccgaggcgggtggatcacctgaggttgggagttcgagactagcctgaccaacatggagaaaccccctctctactaaaaatacaaaattagcctggcgtggtagcacatgcctgtaatcccagctactcgggaggctgaggcaggagagtcgcttgaacccgggaggcagaggttgcggtgaacggagattgtgccattgcactccagcctgggcaacaagagtgaaattctgtctcgaaaaaaaaaattctgtaatttaggtgctgaattcaggcggggttttattcaggacagataatcaatggagcacttaaaaggcaggttgggctgggcacggtggctcacgcccgtaatcccagcactttggaaggcggaggtgggaggattgcttgaacccagcagttcgaaaccagcctgggccacatagccaggccccatctctacagaaaattacctgggcggtggtgtagccccagctactcgggaggctgacttggggggatggcttgagccccggaagtcgaggctacagtaggacgtgttcccgccactgcactccaggcccgccttccggcgctcagatgagcacagggttcgcagagtgaactaggtgcagtctgttaggaggcttggggccaggggtggggggtgggggcagttttgcctttgccccaggctctgcctgggagggaagagtccttgttgccgccacccacttctgtttgtgttttgcgttttgcaggggcggatgtccacgcgagggacccccgccgtgggatgtcgccgcaggagtgggccacttacacgggccgcgtggatgccgtccgtctcatgcagaggctgctggagcgcccctgcccggagcagttctgggagaagtaccggcccgagctgccgccgccccctgaagcggcgcggaagcccgcgggctccaagaactgcctgcagaggctcacagactgcgtgctgtccgtgctgacgccgcgctccgtgcggggcccggaggacgggggcgtcctggaccacatggtccggatgaccacgagcctctacagccccgccgtggccatcgtgtgccagaccgtgtgccctgagagccctccgagcgtggggaagaggcggctggcggtgcaggagatcctggcggcgcgggctgcacggggcccccaggcgcaggaggaggatgaggtggggggcgcggggcagcgcgggcggaccggacaggaggacgcggactcccgggagggctccccgagagccggcctccctcccgccctggggtcccggggccccgcagcgcccgccccgcggaaggccagcctcctgcccctgcagcgcctgcggcggagaagcgtgcggcccggtgtggtggtgccccgggtccgagtcagcaaggcgcccgcgcccaccttccagcccgagcggccggcgcggaagggcagcaccaaggacagcggccacctgcagatccccaagtggcggtacaaggaggccaaggaggagaagaggaaggcagaggaggccgaaaagaagcgccaggccgaggcgcagaaggagaggcgcactgcgccctggaagaagaggacgtgagggcccgtgtgcctggcgctggggccggggctggggccggggcggggccgcagggctgggcgcggagaaggaggcggccccgttgcgcatcgcaccacttccgctccatggaccacggggctgcgcgcatttccaggctgtttgtccaggctgcttccaagagagggctgagggagccacatggattcgcttgtcgccagccctcctagcaatcagtacacctagcgggcacgttgcctaaaaggctccctttagagaacctcaattaagattttttttaaagatcaatttatcaaagggcgttttctccgtaattttgtatttttaatcattatttatcaaatttgcaacgttttacaagtgatagggccccttatatccaaggcagttttaatacacttgcctgaagaccttttgtttaagatactgtttctagcaataagtatccatgatacctgtatgagttcacacagacatcatgggattctcccctttttggctgtttggtcttttctcctcatcgtgggtgtaggtgcacactggatgttcttagtcattagattaagtgttgccggatatttctatttgacggaggcattggctcgttgagccacatgatcaagtgagacagaggatcagatgttactgtatctttttaaaactcttatccatatagtaatatattgaggaaaaacatattgtcaaattataaaacaatggagcgataaacatgtatttattgctagaattaaactcattttaagcaaggggttttaggtaaactggatacgaaatctttaacattaaaaatagatatgagaaaaaaactgtcattcgataaaatgaggcaaatttaataataaatgattaccagaaatacaaaattaagccatatgtgctcttaagtaattcgaatccagatatccttaaaatgtcaaaaagatgcaacaagagtcaggagcccagaatgacgcaaattacaggaatggggaggaggtgatttttagaagaggtgagagaatggaatggggaacagacttgttttcggcaaattctcctggagtagactgggcagccccctcctccaggctcagttccaaagagtccgttgtgtggatatttcttttatttttcctttgaggactgcgcttggtgtttagttcatccttatgccgacctcttagaatttccaagatgcagggccttgggcagggcagggcatgggtgtgatttgccttgggccacaagctcttggtgagagtcttatgtccacacttttatctccaaagtgacatggagatcacttttctcagtgatcaaatttgaatttatcaaagggggttttctgcataattttgtatttgtaatcattatcagatttgcagcattctaattcggcagggcagggtatgaaagctggaaactcaggctggagtttctagttctaatggctctctggccatgtgggttgtagagtgtctgtcacatatgcactttatttcagtattaattgaaatacttggacacgcacgatcacaggcctatttggaggctctgtactatgaccctaataaccctagatacatcatgatacatggtgtctgtctcaggatgcaggcagggctggtgcaggcttctccatactcccttccacttggcaccagcaggcatcgagcaaccagggatcttaaactggcctctccaaatactccattgaacaggactgcaggctgcacccaggctaatgggagattggtgtgttgatgatacagtgtttaagatgagattgcagtgagttcctccttaatcccagaagggcaccatgatgaatgccacaggagactggaccctctttgagaactgcagatattagttgactgtgggtcaccctcgtggccaaggagttgggattggccatgtcttcttcgaggaggtggagactgtaactgacactggttatctttggggttgtctttcctgaatcctttggcatgtggcaccttcctgccacatgtagataattcacggcattaccaagtcaccacgagccccaccctcacctctgtcaaccgaggacccagccaggcagtgccatgtggtctcccaggcacgcttctcaacaccggctacccctgctgtgaaggttctcaaggccctggtccggggagccaagccctgggagcgccctaaagctccgcaggtaactgcactgcagcccgcattgagaaccgcagctctaacacagtgattgcgagaggacacccattctgagctcccacagagggctccacctccccaagaatgtctcattgtcattggaacagccagggtcaggcagcttctgctcggactgacgtggcgtctgacccttggtgggttgccagacattcctgcctgtttccaccatgggaagctgtcactgggaatggtatggagccctcacttctaccccaagcctgggtgtctgctgcctccatgtcaaaaatggacatttctggtcctgcccagctgctacctcaccacaacccatgctcagagttgtcagggatgcgtggaacagcaatgatgggacagcaaatgactggcaatttccccaggtcccacgctgttctggagtggacgtgttgcggccctgcccccgatgtgttccagcctcatccaggtgcacaggatactctggggccagcacagggattgtccagtgatgctcctggtgtccacaaaacagctctagagatacctgcattttgaaaagcctgctgagccaacaagcttggggcaggacacggatttctttggcaaatctgcaggcgagctgaccacttgcctggtgagtggaagctgccattacctggccagtgtttgcaactcgagggaaaatgacagctgcatggggggaagcctgacctcccggggagctttattgtggcctcagtggaaagattggattttgaaacctgccagacccaactgaaagaagggtcattcctgattgagttggagactctccccagtccctctctctggactcattctagctgtggcctgcctgtggacagcccttccctttggcccatgcggcgggtccaggcagctcctgcagctgtgctcatggctgctggcccagaacttctcatttttgccatgtggaagcagatttgctagtagaggaattttccaagtcaagggaagtgttgccaaacctcttgcctcgacctgtggggggccttctgctcttgttttctcattctctttggagtgggcacagaggggacaagtcggcccccagtgaggctcagggagtgcaggagaccagggagggaagcccagatgatggggaaacagagccaccttgagggggtgtcatggggtcagtgtcagggtgatctgacgggtcagttcatacttaagcaacattattctgttcgtttcttttgggtaaggaattcctcatgggaggtgtggtcatctggtcgtagaggtggacagaaacaccccctcgtcttcctgagccatttggaagccctttcctctagccctaggtactggtgacacaggcccctcggtctcaggatgtggacagggctgggaggtgcaggcttcttgtcccatccccactcagtatcatcgggtatctggtagtcaggggtctcacagtggcctctccaaaagcctggtgtccttggagaacatttttcattttgtctgttttcgttgctttgaacagctgcattcactcaccgagggctcgccctccctggatctgccatgtggttcagggaggaggggaccgatgagcaccgaccccttctcttcacctgtcagtggccaccacagtgccccctctggctttgccaccacgttctcctgcccccgtcaccttgtctcttctaactcattagcctttccttcctttgtctgttttcttctcccagctggtttaagttcttgatcatccctggcaccacctaccctaaggtcttccaagaacagaaaagccagggcctgtgtggggcaatgtgttgtccctgtcgggttatggtgggacctcctagaccccagagtgaatgaatggcaggcctgccagtgactgtgctgatggcttagaattcctacacggctgtgcctctcccaccccgtcctctttgctcggaagggagacctggtttgctctcctccatgacagcccagcccctgctgtgcacaggggtggggctcgggatccctccctgcaccctgatgtttattaactgtagatagtgaatttcaagttgacaggtaccttctcagggatttatatataaatatagttagaggaaaagttgaagtctattttactactttttagtgtttgagtaaattatgctttaactggacagaagaaatatttctcagacaatgtcgatgctgctgatgacaactgagatgcctggagctcacccttgatggagacttccttggtgattggagatgggggactctggtggcagaaatggctttggggtaggtgtgaagttgcttcagtccctctgagttgcctcttctggatggaacgtgtgtatcaacaacaatgaaatgcacctccgtgtgcatggaggcggctgatgagaatacagataggccagtcctcgctcttccctccagaaccggccgctcccggtctgacgttggagcacgtgaactaagagtgacaattttttctacttgcttctgtgaataaagtgttctacagtcagcccagcactaaactcaccagaaaagaggagggaacagcacggagccattcatctggaattactcgatgtgcagaggctgccccttggccgcacttgggaacatcgtggacatcttccttcctctcaggctcctcctgacagactcctggcagcactggagacctcaggactatggagatcagaattgtaatggctttgtcatctcagtgtggccactcctgaggcaagaggctcctcctgggagcaggagagagagagtttgtgatgttggttggaaaataggatttatggatgcaggagggccgtgctaggcccctctgcccgcttctctccctgctgttggcggtgaccaggtctcaggagcggagacgaggctgttgtgagtgaaacagaagcccctggcatagggccagaccctaggcctgaaaaggatgcaaagcctgctgttttcaggctgttgggaagaatcgtgcgtaccgagtgattatgatgaaacgtatcccagagaggaaatgaatgggacctgaaaagtgggtctgccacatccctggtagcccgcctccaagagcactacactccccccagccccaccggccacactacatgacgtgggaaggctgtccgttcatccttaccctggggactcaagtgtgctctgcggagtgagtcacagccctgatgtgcaccctgcactactctttccccaggtgcgccggagacgcaggcttgctcatttccgtcctgacacagctcgctgttcctgcggtggtcagagtccccctgtgctgtgtcagctcctggacactactagtctttcacatgataaagcgcgagcactttttcgcttttgcagtatttggggaaattctaacacatttcccggggatttgcccaggtccctccacctcccacggtgggtaactgtgtggattctgcacctggcaatcggcgctcccctttggaaacacctgggggccctgtttcttccagcctggtccttggtttctaccccagccgctttcagccggcacctgcatgggactgcctggagggccacggtccagggaaggacaggtgggaccctgaccatgacagatctttctaaaacaataaagtcccattgatgacaactgcagtgggatgaatgccattgcagcggtcatgctgggagctgccgagagcttacaacaaaagcagttcctctcaagacactgcttgcatcttccctccacgcctctcggtgcatttggaacttgtttatgcgctggtataactcgagtcagctgcttatttctgtgcccttgcactcacaggttccttcattaacattttaaataagtggctaaaaaaactcctctggaggttgtttttgaaagagacaggaaaaagaaacacacagtacctggattgttttgacttattttcaagcgactcagctgaaagccggtgttgcatacacaatttcctcacgctgacccagcctgactaagacttgataaaaggcacagcccttggcagcaggcagtgccaatgtggacagtgtacactaagctgtgagtgtgtgcacgggcgagcacatgtatgtgtactcatacatccagatgaactaaagggacactgggctttgtgctggcaaaggttacgatgctgctgtagcttggctgtgggccccaggcagtgtcagatggaacctgctttgatggcgtgttgttcagtgtactcagtggggtctcacatggcccgaggacccactgtgagcactccgcccgctgtggcacagaacacggctggggtcatcacagcccaggtctttattgaaaggcggctcatatagaacccatttggccaggtctgggccatctctctgcctctgccctatcttggctgcctggaggggcccaggcccaagaggattctttacccctggaagagctccccaggcattcagcctatggcccttgacatttggctgcaggttaccgtcagaatcaacaccatatcctgaggaagccctggtatttccccaagtctgcctatgtattagacactctaatcaatgctaacacagttcagtttttgagggaactagttttgtcataatactacacccctctattgtttttaaataagaaaaaaaaaaaccccacgaaactttccatcaaagcaatggtccgtgttggcctgatgctttaagaagtttgaggaggtaggtatggaggcaccttaacaccagtttttgagcagaagttctagaagctgatttagaactacacagctatggatacacctgatgaaaaccgcaaaaggcgatgacaggcccagaaatatgaccagcaagcccgtgagcctttggggcatccgactgaatttgaaaataataccccattcagatgaacattaaaagccaatgtactggaattctctttgttctgcccgacatttgggggtgtccaaggacctgtgtttttaacaaagatgactttatgaccgttctaaggattgaacagattcctgcacagggtgccaggtttcaagttaggtcctcttagtataagctctctttttttctgaatgtaaacctatttgcattgtcatttctaataatccagtaggtttctggatattgtaaagatactgagtacagatataactgtgtaaatttcatagtgttttattttgaggtgagagttttgttatagtttataaaagatattttcctattcagacctcagggctattttgggacctacaaataaatgtgattcccagcagcttcaatttttgatattcaaaaagttaataatctttaagctaaatataatgtgatatgattcagaaaaaaatgtttttcccttttaacttctaacaaattatgtatctaatgtttaaaaaatatggaaaaaagggataatgtaaaaatgtgggagaattgtggctaaagaataaaaaatcacttgttaaaacgcattcttatggtacaaatgtgtgatatttaaataaacttaagtgtgtataaattagagaatgatacagtgaaatataccaggatttttcatgtcacttcttttcattgaaatagacgttcactttcttatcgtgacaaactttcaccttatttttcaaaggtaagatttaaaaattgtgagttccccacaaatagtttgtcacatgttcagatgatctcattacaatctgcctcttctcagaagaacccactggcaggtgggcatccttcagggatgttgccatgaatttatgtacatacataaaaacaagaatataattcagtttctatgtgttcttttacctaaatggtacactgtacaggttgtccattagtttcttttctttacttaaaatatgtccctagagagctttttaaagaatttaaatattttcttttgacagctaaaaaagtaatacacaaatatgagaaaaaatgtaaacattgtacaaagttctcagatgaaagtgactttaccttcccccaagacagtccctcagaccagctacttgtacatccttttagaaataccttttgaatgcgttcttccctccgtactgtgcaaacagaacccgatgggatatagagtctcattcactcactgtgttttgggaagggcatgttggtccctgctttgttctttttcattgctgtgtagtattcctcagcagaagtgcaccatggttcatttaaccattttctcatgggtgaacttttcaaatggtcccggtttttatgatttgctagtaatgaagatccttgtacctacccaattgtatacacaaatggatatcttttaagataggagtgcagaagtgagatctgccaggtttcaaagaatatgtgttttaattgctatagtcactgccatggtgcactttgcaaagctctgtggtgtgtgcaaccaccagcagggagcaagagaggccctttcccaatagttagaaaattgtatctcgttttaattttcatttcatttcattttcccagttgttgatgtggctgaacatcttttcacctgtttttcaacattttaatttcctatttttacacatttcttatttatagccatgtctcatttggtgtttttttttttttctttctaaggatgggggtggtgggtggaattttatttattttgttttttttttatttttgagacggagtctcactctgcctcccaggctggagtgcagtggcacgatcttggctcacttcaacctctgcctcctgggttcaagcgattctcctgcctcagcctcctgagtagctgggattacgggcactaatttttgtatttttagtagagacggggttttgtcatgttggccaggcttgtctcgaactgctgatctcaagtgatccgcccgcctcggcctcccaaagtgctgggattacaggcatgagccaccgtacctggcccctcatttggttattatttcactttttggtgtcatttttgctggaggttgatatgtatttgggatcatatttcattcatgtggtgtgcattttctcttgttttattaaggtattttctgtagtgtagaagatttaaattatgatttagtcaaatttgtctaacttttgtttgttttggtatttgcatcctgtgttttttttttttaagaaggcctttcctaccccaaacgaacaatctttttcttctatattttcttctaatgacctataggtactttgcttttttccttttagctgaaagacatgtacctgtatacacaactcgtttaggttatatttgatgggactgaaaacaaccagcccctatttatttgggaagctccatttcgaacgtaggaaatcggaagtctcaatcattaaataccataatctatgtgattattaaggaagagtctaagtagggaataaaattttacatatgaacctttgtcctagggcaagattgttattggagattatttgtgctcatttgtgaaagagccaataatgtgtgtgtgttgggtgaaacatgattgaataggaaggtcacacacaagggaggatccccataggaaatccaaagaactgggacgggaaaagggaaatggggttggggagggttgggagaaaggtgatcttgtctccttcatcttcctgactggagatactgggggaacggtgtactaagttctttcccgtggaagatgggagcatcttcccagggagctggcccagtccagctgcctcgcggctgtgtctgcccacgctgggctgaagtggtcaagaacgtccgctgaggattttacacatagccccttgtgatcctccttcaccaaggccctttacatggtctttgctcccagcaggtcatgcctgccattttccttgatgatgtccaggctggtttccatccagggacatgaaaggtggccccaaagcttccagtctgatgacaactttgatgtgcaaattgctcaggcagaaattgtcagcttgccagccaggggcttcccagtcctgaggggtcactgatccctcagcagtgtggcctgggcaggggtggggaaggggtgacagcccccgggcaggacggccaccaccgccatccccctcacatcacctgtacttccagccttatgctgcctaagccctttactgctttcccttaaaaagccaacagaaacctagcaaaaggttaataggttcttttggctaaaaataattaaaatacatcaatccaactcaaaagcaccttgatattccaaaagcagtattttaaaaaccaatcaagaaattggtcagctgcaaggaaaatacttcacctttttattagctcttatgtaagaaagaagccttattcatccctacagcctaggtgagaagctagactaggaggcccctctctaggccaagggagacaggagggttcaggtgcacggactgtgcggggaagccggtaccctgtactgaaaaagctgtggaatgtcctcactcccagtgcaagggggtacttggggaagccaccctccagcctgggctaaagatggccagtctgtgtcctgcaaaaagggcctgccttggtgtcagccctgggcaccccaatgccccttcaccccttgtcgggggccctgacctgcttataggccagggtgatcatttgaagggatgacaagtcctgcctcgccaagccccatctgaaagggcctcccaggtgcacatgagcgtctcctggcttgatttaagcccacaatgtctgttggagcatgagaggtggcaggtaggggtggttgagccaccgccacctgcgcttcctccccctgctttgcaggtgctgcccctgagtgtctcctctgcgtgctcagccccaggctgtgttcctctaactctacacgctggtcctcatcgtggactcagggccaggtggcccttgagacattgcggcaactctcatcttctcagtgatgaaccgcatttacctgcaccatggctctccatgggcggtccccggaccagtaacatcagcaccacctggaaaattgtcagaaatgcaggttctccagccccacctgtatgcctttcttcgagttgccttagccaattaccgcaaatgtggatagctggaaacaaatgtattctctcaaagctttggaggccagaagttcaaggtcacgcgatgttgtcagggctgcgcgccccatgaaggctctgcgggaattccctcgcacctcctccagcctgtggcggctgctggcgacgcttggtattccttggagagggcctccttgtggagagggtctccagtctctgtctctgtcatcacgaggccattgtctatgtgtgtgtgtccaaatgttcctcttcctataagaccacgagccattggctcatcgctaccctcatccagtgcaacctcatcctaacttgcttgtatggacagagaccctatttccaaataaggtcacattcacagggacatgggttagaacttgaacatattttgcaggggacacaaacccacaccactaccacagactattgaataaggatgttgagagcctgggagggccctcatcccaccaccccggccagctgcaaatctgatggtaacttctccatctgcgtgagggagagatttccaccctggggcatcgggttggctgcgcacccaacacctgacactggacacactgtcaacagtggtgtattcaccacatgcactcacagcccaggaggaggccactgcctgccacacagaccacagggggaacagtgtgaacaaccaggacctgggagaggcaggctccgtggtatcgagaagatggggtgcccccactccgtctccataggaagatacaatcggctcgttaggaacattgcaggggctggtgggccatggaagccgctctgcaggggtagcaggactgcgtctggtccagagacaggagggcaagttggttgggggccgtatccatggcagcagagcaggacagggctgcatctggtcctgcaacaggagggcaggttggctgggggccgtatccacggcagcagagcagggagcacagcgcatggttggaccactccattctctcctgggttcacccagagtcaggagcaaaaaatcttgaattttaatttcaggctttatattgtattatttgtaaaatagacctcaaatccttcacccattctctgctaccagcctagcctgagctaccatcacacctcccagacaacggcctcattccacgttcgttccccgcaaatccatccttcccttaatgggcagaaggatctgttgagagtatggatgagatcctgccactgtcctgctcaaaacctgccagcagtctttggttgcacctagaaaaaccacccagcccctgtcccatggcctggaggcccatggggtgtggccctatctgctgttcctcttcctgctttccctgctcagccttcagcccagtgtcattgctcaggtccttgccgggcccccagctaaatttagctccccttggggtgcgctgccccccgtcaccctcctctttcctttatggcattttctatactcttctgcttggtgtccattccccatgatgtgtccgtcccagcacctaaactgggcttggcccacaggagttgctccctggtattggtgagctgacagagaggagggctggggctactttttgacttgggccttgcgactgagtgggaccatgagcagagcacagctctccaccccagggcagcagcccggacctcggagtcacggcatggcctgtgggtcaaccctgcccgccttggctgtggggcatgggcatgttatttaatttcccatgcccagggtcctcatttgtaaagtggggattgtagggtttgcataacaatttaattaaatgacagaaattctactcagatctttaacaaggctgctgcagagttggaggccactaaaaggtagtttcctgcctttctctgtcctgcttcaaactaaataacagatggctacaaaatccaggaccacccagggtcatcttccagagggccagtcactgaggctgcaggtgagggagttttaaccctccccccagcccctgtctcccacacccactggctcactttccatcagctctaaaagtttcctgactatccaggggccacagctgcggttgcctgggcttttccattcctgagactaaaagaatgttcacagctggaacctgcaccaaacccacccagtgaccccagatgaaagccccctgtaccccatagagaggcaggagcagagagagggcctccagtcactccgtgctccagggtccagggtccagctggggtttccagctcccctgttggcacctgttcccctctgcgtctctggcaatgactcattcccagggacagagctgccttcctgggggatgagcaggagctgcaggaagccagaagcgaggctgggggcagtggtccacctcctcaccccttgtgcccagggttcagaaaagtgacctgccaccagcggccgcctattggcgtgtgggaggtggctgtcctcccaaatgctgcaggacattgctgattaggctgcttcgatgtgggcgttttttgactaggggcatattaaatggcaatggaaaccagcgaaatcagccctccgggagacagcaacgcggaaagtacctgctccattaggctcagcctggctcttctcccagaaaagcagactggatgaaggcactgggccagcttaatgaaacccagcagcagtccacgtattctttttttttttttcatttatttattttattaaaaagctaaaatatatatttaaaaataactttaaaactattgaaagcacctgtgcaaaggtgggggaaagtcaatttgagtaactaggaaagccacaaaaggacccactgccctgtgtatttttgtaatttttgctcctatctctgcaagtaataactcaaacattgcaatcacatgcaactaaggtaaaatgaggtaaactgctctgcagtgagttcttctactcagaaggcagtaggtgagcatgctggaagtcacatgatcaaggctgcatctcccatcatccctctgggcagtgatatgggatagtgggtctctttgaggacttccaagcctgagagggggatggacaacatatgattcattgctggcttgggtccatgtctgtggtcaacttcacataattggatgggaagagccccacttgtccattgacttctcctttccaccagtcggggtcctccttgttgaggatgttgatgatctggcccttgttgaaggccagctcatcatcattctgcgcggtgtagtcgtacatcccaatcacctggcacactgccgctaatgctgttgacttaggtggctctgttggagtgattttgctcgtcccagggcttagaagctttacataattagctgggaaccagcctatctggcgctttttcccacgtgcttgcagctctccttcccaccatccacctgggttcttttttcagatcaaaatcagctgaccaggggcgagagtgagctgctcggggcccgtggcggtgtatgaggaaataacctgggcaatttcaggtttttttcctaaactccctgatttccccagcagttccagagccctctgaatctttaagcctcacatagttagaagggaagactccggccttgtcgcccactgttcctgtccaccggtcaccatcttcttggtaaccaaaatcacatctccttgctgaaaggttaaatctccttgctcagaactctggtaagtgtacatggcaataaattcttctcccgaaacgactggcttagcagtccacgtattctaggctgtgtgagaagggggcttcaggggcagagacggggttccacccctggctacacagtttctccagccttggatgcatactctctgtgtgactctgacagtgtttgttacgtcctagagaagagcaaacttctgaattcgctgcacaccctgcctgggccagtcctggacagaacgatgctgggggccactctgagcacagactctgtgcccatcaccttgactgacagtcctcaggggttctccatctcttctctgcctcctacccccccaccgatcaggaacagttccccaacctcccccaccccccagcaattcttgatggaaggtagatcagcataatacagcctgcagtggggtgtgttttaaagcaggggccccaacccccgggctaaggcctggtgctggccaaggccacacagcaggaggtgagtggtgggtgggcgagcgttaccgcctgggctctgcctcctgtcagatcagcagtggcattagactctcatggcagcttgaaccctattgtgaactgcgcatgcgagggatctaggtctcgcactccttatgagaatctagtacctgcctgatgatctgagggggaacagtttcattctgaaaccatctgctgccccctctccggccacccatccgaccccagtcattggaaaaattgtctttcacaaaaccagttcctggtgctgaaaaggttggggactgctgtttaaaatccttctgaattctcacaccttccattataggtcttcctccaggagaatcagaccacagctctttgccccaggccctgtgtgagccccggctctggtgcgtggccttctagcaggtgaagagatgcactcgctccttgtccctagggccatgctgtcatcatggtctggaagaccccgtggtgtcctcagtaccagcaacagcgtcccagaccatctgggcccaaatctttccaatcctggtaagaatagtcggggacccccaggagaagccccccgcttctctcagagcctagagtgaggtgtggcgaagaggcctggtctggggccctctgagaggaggggacccctctggggtggatggtgtcccaaatctgctctcccaccatccagccacttggaactaggagaaaagctagggcgacaggaaacgtgggccttctgtgaaacaatggagcctctcctctcggccccttcaccctgcaggtggcacccaactgcagcccgtgctggcatcctcagggctagagctccagcaagcatggcctgctgctgcctctacagactgcagaacacagccaatagatgatttcattatgtccaggttcttttctcatctccaagcgaggaaaaatcatgccgcttttgtaaagaaattatggacacatgggaagcttcagaaaatcagggctgagaaaggcatgtgacaacatgctcagacacggcccactgcccctgtatttctgaccaatgaaacagtatgcaagggggtcttatttgagactccctgcccagaccgagcacagagagtggcatgctcctgaccctcgggcagcaactgctcccccaagagaagggccttggccagaggcagctgcataaagaaatggggctgaggtggctatggagccattcgatgcctgtgtctacatctgtttcccaaaaaggttatgggtgcactaggcacccagactgtgaggtttcaggaaatagtttccaagtctgccctcacttctgacagcagctgcaagcttggagggttccccaagctacctcccgcattaagagtttgctaacaggattcacagaactcagtgaaagctattatactcattgaatacagggcaagggcactgacagaaatgagccaaaggcagagaagcatggggcgtcagggagggtctgaaatgtgaaacttcccactgtcctaaggatgtgtcaccctcctgagattgatgtgtgacaaatgcatggagaattgtcaaccaaggaagcttgccagagcttcagtgtgcagaatttgtattggggcctcactatataagcatgaaagaatgattgattgatcacatgtgtaattgaaatcaggcaccaaggccactgatattgtgtaactcaaagccaccattgttggtctttcctgcatggccagttcttatcctgagactgtcagatgtggctggctctatgctaaggttccatgtggccagcctttgccaccaacaaagacactcctatcaggtatgccatcagtcacctcctagagctgagggaaatggccagaacccctctgtgggcaaggccacattttttcctatgtacctggctctgggctgcactggtaacaagtcccatgaggcccactgacatccatgcagacatacttgatactgggtctgattgtatcccagggtcatgccgtgagaacagacacagagaaaatggcagaacccggcttccacagccagtgatgcagagcttaccaaacgaaggttaaagaggaggtgaaggatgagtcagttacaacaggccccacccaaggggacaactccaccaacccccctgctgggcacccatgctccctctggggcctcagccttgacttttagtctctgtatgttttcttccctcctttgccccacacatccttggagatcctttctattgtccacaacttgaacgctgacttagcacaattgaaccagtagttggctaggcgggttatattctgttgccccagtgtgctctgtcttgaaagtgggttctactctatttttttggagacagagtctggctctgttgctcaggctggagtgcagtggtggggttcttggctcactgcagcctcaacctcccaggctcaagcgatcctcccatctcagccacccaagtagctgggactacaggtgtgtgctaccatgcctggttagtttttgcattttttgtagagatggggtttcatcatgtttcccaggctgctcttgaatgtctgggcttggccgatcctcccaccttggcctcccaaagtgctaggattacaggtgtgagccacacgtctggtcggcctctgctgttctgagctcatggtttcacaggggagctactgaaaggtattgaagagtaatgtctcttcctttgttcaaggttctggaaaacccattctggcttggccattgtgagcatatgtaccaggttaggtttacctgcacataacagaaaacccagtaaccatcattgtcactgtcattgtcatcatgatcatgatcatgatcatggcctatacttataaaagtgcctaccatagtaggaccccaagagttagaggaatagttaggtcctctaattgcaagtcacgtaaacatgacataacatagagaccatttcatgctcgttttacagatggggaaatagatacagagaggtcaagtaacctatccaaggtcttgatgctagtgagtgaaggtgctgagatataatccggggtgttcagcctcaaaatctctactccaaacttttctgttacaaccaagaaaatagtggcttaaatacttaagggtttgtgtctccataaacaaagtccagagaggcaggctggggcgatcatggtggggccactgtcaccagggacccaggctccttctgttcagtcatccttggaaggggctggtattccctcattgcctcatgatctgaagtagctgctggaggacaagccatcacacctgttttccaggcaggaggaagaagtgagggggaaaaacaggcaaatcttctggatgagtcagctccctttaagataccatccttttatatagcctattaaccagaactcagtcatgagtcacacttactgctaggttggaaaatggagcagtagaactgggccaattgctggcgtggatataacgcggctccagtccaaagacagaggggagaatggacactgggaagcaacttggcagcaaagccaagaaaatcagtttctttattgtgttttctttcctgaaacgtctcctggggggcaagagggaagaggccccatccttttctctgtctgatttttggagctcttcatcattctagacctgcttgccccataggactttctcttacagttccctgttccagggaccctgaagaccagccctgcaatgtgtgcatagggggtcctatttggtgctgagagagacagggtctagagcatagagttggatttctgcacagtgaaagcaggactgaagtctggtctttaaagatttcctccttttcatgatatggcccactgtcattgtcattgttatcactgacaatgatgacatctcttcaagattaataggtttcagacttatagtgttaccatcctgggaacaggacctagacacctgtgaggttccaattattgacctaaacggttgacaattggaggacctagctgttcctctaactcttggggtcctactttcacctgaatgatggattgatttgttccatcaatcaaatgtgtgaaaatgacagtggagcttcctgctctttaaaagttggtggtagaaatcatagctgtcatattgatcttagctttgccacctactagctatatgatttaagtatgttattttaccacactaagcctcagtttccttacctgtaaaacagcaatgacgaaaatgtctaccagtaggatatgtgagcatctagcacatagtaagtgtccaataaatgtgaggaggaggatgataatgatgatcatgatggtggtgatagtggtggtggtggtgatggttatgatcatggtggtggtggtgatagtgatgacaaatgatggtggtggtaatgatggtgataatagcaatgatggtaatgatggtggtaatgatggtgataatgatgatgaaggtggtgatggtgagagtgatgataatggtaatgatgatggtgatggtaattatggtgatggtgatgatggtaatgatgatggtgatgatggcaatgatgatgagggtgatgatggtgatggtagttacggtgatggtggtgatggtgatgatggtggtgatggtgatgatggtggtgatggtggtgatggtggtgatgatggtgatgatggtgatgatggtgatgagggtgatgataatggtaattatggtaatggtaatgcaatgatggcaatgatggtgatgatggtgctggtgatgatggtggtgatgatggtgatggggatcacgacggtggtgatttaggaccagaatctccttcagtgggaaatctgtctacttcaagacttttgtgattaatgaaagaaaaagtataactctggctaaatttatatgggttaaacaaagcattaattaattaataaatgcccatttgtcattgtcttatgttcaggttagttaattgtccttgaagaaaatgctggtttagtgatctaatgctctttcttagacactgcaatagtgttgcccctgaaaagtaataatcttttggttttgttattgtttcctaggataactttctttgggatccttttgatatactaagagcatctgtgaggatagccgaataactattaggctgaaaaaaaatagtattaaggcagcgaaaatactttagctgtgaaactaaacaatacatatatgaagtccttagcatcatttagggctgttaaatatatgtgatgtgacattacaaagcaatttgagatgatttccttagtatgcatgatggaaatgattcataattaccccaaataccatttcttaggtattgtttttatgcatgtattaattatggctgtggttgtttttgtttagagatgctttgtactccagtttgtcttcttaggcacagccttgcctgtgatggggcaagtctcaggatgtgggtttcttgcattggccactggtcccactgggtgaggatggaggtgtcattggtatagaaggtagggaatttgtgatgaaacttgcatcttttgaaaagttttgttttgtacagtgctctgaaatttgtcttttatatatgcgtgacgcaatctagttgcacatgttgcagctaaaagcggaaccaactaattgaacattttcagagtctgacggaaatggtgggtgccagcattcctagtctatcatccagttagtttggaggcttgggtaagtgccaggtacggtaagaaatgaccactttctcccagaactcacatctagccttcactcctgtaatagaaacagggatttgttgagcggctgcgataggtaggaattctgctagcagacagggacacaggacaagggcaaagtccctgccctgaaggagatctttacctacatgagtttcttttcatgctgcttttctgcagacacacacattttcctctcagctatttatccctttgccatgcacactgatatctgggaggttaatcaacttgagggacacatggttcattttggaaagcagctgcaattctttgcaaagaggtttctagacctgtttttgagaatatttaaatcgctgagccaaaagccagtgtgactgtccttcctgccctaggtgagtgtgctgggaagccaccgaggacattgatcttggctcttctttgtatcagtgattgagaaaacaaacactatgctggagagccactgaacgctctccctgaaggcaaagatttgctttatctaaaattttccattgcgtccaggagcaaatctgcatcacagcaatttactattttctgctccaggaactggaaaacacaagcttgagctacgttagctgcttccacgaaacgtgctgtcatcactgaaacacatgtattttttttttttcaggattccaggttgagggaaatttgcttttgattgtttaattgcattattatagatttttagtggcatctctggcctccatctactagcaacctccagacagtgtcaaatgttccctgggggggcaacatcacccccaggtgaaaatcattgccctagaaataatgaagatcattattagtcctctaagcacattccatgttctcagtacatccctatttaaagactaacacaagtgggtttctggtgacttgcacaggaaactgagtccttatgctgcaaaatgttggagtctttcttttaagtgacccttggcagtgcagaatgctgatgtcaaaatataatcaaaagctcattccgggcttctgggtagagttccaaatcctccagattatattagttcattatagcagaccatgctggggcttttccagttgacaaattagatttttttgaaagcatggcagttggatttatgaaaatatttaggattaaaggggaggatgagggaaactaattttctcttgtcatgaatgcccttaattgaattttagaaactgtttgaaagagcaaggtgaatgctagacagaaggttgtaaagatgtgcagataggtcgaagtaaaaacacatccgagatgctttaaggacccagagaaaaatcagccgcaatgaacacttactttagctaattttatgtgtcaactcggctgggtcatgatgcccagatatgtggttaaacattatcctacatgtttctataaggatgttttgggatgagattaacatttaaatcagtagactttctgagtcaagcggactgtcctccattatgtgggtgggccacatccaatcagttgaaggcttgaatagaacagaagattgaccttccctgagcaagagggattctgccagcagacagctttcggacttgaacagcagcaccagctcttcctgggcctccagcttcctgccatccctgcagatatgggatttgctaggctccatactctcatgagccaattccttaaaataagtctcttcctatatgtgtagcatgtgtgtgtacacacggataaacatgtacacacacacacacacacacaccctactggttctggaggacctggcgaatacaactgtgatgaggatgtctcaagttcgcaaagcctcatgattcgccaccaccaccaactccctccctccctccccattcttcaggcgcatatggctgccggcgcctcctgggagggttacaaaatgcctatttttttgttttgttttgttttgtttttgtttttatactgcagaggtcagcaggatgccaagtcttagggaaaaagtttactttcgaatttgtaaaaagcagcatttaaccagcacagcagctgtgaagacaagaaaagctgcagaacagcagaatagcatgggctgccgaggcagaggcagatgctttaacaataaccaatgaatgacaaacccactgggtctggccctatctccccatggctctgctctctcgcccccaatccctgccctttctcaggctgcctgcgtggcgctcatccaggcctgggtgtgccctctgcttggctggtggtcattccacggtctccttgaccaggttcctgtccaagccatgggcacatcacaccctgtagcttcacttcctgatacacacacgggggttcacctggtgcccaaacctagtaagtggcaggaggcaactgaacctgagccctgcctgagcttccgggttctgcggtccaggcactggctccatcaggggccggttttagtttgaagaactggagctaaggaggttctttgaaatggtgtcgaggtggcagaactccaggacacatttgaatagggtccctgttctccttcctccctggacccagaaaggaaatgtcccagggattctctccctccaggaggggtctgcggagagagggggtggccccagggacctagcctctgggtcagggtggagcaacagggatgtcccaggggcacattgcaggcacagggaggggctgcttgcttctcgggtggtcgcaggggagagctcagggcttgtggtccatggggcagcagatgaatgagtcaggggcactggaaaacgatgtgctcctcttggtaacccctccagtcttggatcattccagtaacacttgtaaacgttatgaagaaatttatcagcgaaaacattcaaggcgctgtgctttgtgctggggccacctgagtccagagactgcggtggatggcatgcgggaaccagaggcacgcacgcgccgctgacctctgggtgacaggtagcccctggagggtccttagggcccagcaccctcctgcccatccctgctccgccaacactcacctgggcccctggcctcctctccatctcctcattgtttctgaacacagtcttgattggcattgatccaaccatccctttctggaatcttcttgccaactgcaaatctctgtacccctctagcaccctttgtccatactgggacccctgtcctcatgatcccagtcacgcctctcatttactgagcatctgtattaaccatgaggttagcgtgtatgacttcttttcatgctcacaaaactgagaatgcagaggtgcaattgggtaggtggagactggggtccagagacgctgatggaggagcctcttgctccagcagggctgaagtttgagcctgggcaggggtgactctagagcctgtgcttgccccggtgcagtgccatcccccctctcccttcctcaagcctgccattcaccatctggcctttaccacacataggtgctcacgaccctgtcttccccggctctgcacagcagaggacagcttgtcccccacactgtgtccctaatccaggggcagcagctaagcagagcttcttgctccctgtgggggtttttaggtcaccatttgtcctccttacaggtctcctttctccgtgttttatgccttctgtttaagctcagcctttcccggtccttactgctgtcatctaatcacccctgggatgtgctgcttccctgaggatttcagtatcagtttcatagtctctggggtctcagcatccacactgacccttccaggttttctcttttcctcgactttcctcaaatggctccttgccatcctgctgactagctcccctgagtttctctgactgccagtctctcttgcctccttcagacccccgagctgccctttccatgatatctgtcccttctgggctagcaggtgataacgtttgtttggtaattgaacataagcctttacggtgacactgcctgcgtgcaagtcccaagtcttccaagcctcagtttcctcatcttgtaaatgggtatgacaacatggggatccatctcctggagcagatggtgcgcgtctatggctcagacagtaacgcacgcctgcacagaaggagcacctggtgtgagtcagccatccctgtcccctgggctgggtcccgggctcagtgattgtgggcactgtgggaagcgctcttgatccttcggcccatggccatgctctggccccatgttaatccccacgcttcactgcaggcagcctctacctcttccaaactcccccggtcatggctagagaaagtcctaagactggatgcatcacttccactacagatccactctcctgtctcagctccgtctttccaggctcagtaatctttcgaatcatccgttagtggccttgcatctcaaacaacctgatcttctcagcgccctattctgcagaagctttctcataggtttgttgagaaggctggctgtacatctgcggtgggtgctctctgctgtcctcttcccaacctcagtgtgactttcctgcgtccacattgacttctgtccctctcgcctcccctcaagggtgaccttcctgctctggctcatgaactcaccctctgtggggccccgggacctctgctgtcaatgaacatcatgcagttgttctctttcttatgccttaaatcactctggggcctttccccacaaccatgtccaagtctccctgtagctcaggctaaaaacaacttttcttcttcaaacctaccctcccctccagtgaaggtcttacctatagcttcccattataggcaaacttttccattcctaattttgcgaaatctggcttccatctctccacttaccagaagcccctgctctagggtcacagggtgatggaatgcagtcacctgtctgcagctccctgtgtcccatctgccagaccccctggcactcatgaccttgtgtgtgctggtgtgcctctccaaccttccctcacctggcacctctgcactcatgccttcagtgtgtctccatggcctctccgtcactgagtccctgcctttatcagcatctccaagcagatggatcccagatgtctctccagccctggcatccctccaagcagtggtctcaccttgtcaaagccctgcacagtagctctgcttggaggccacgtgggcacactggagtctgcccagaatggtctcttgcttcccatgttaattcctcctccattcacgctggcttttcttaacaccttcgccaacatcctggccatccagtcttgaaaccgcagcatgctcttgacccccttgcccttcgcatcaaaccacattctgtgttttctgttatttagtccctagaccatggcagggtgaggtgtgatgggttgtgggatcagaatgatctggattcaagcctcagctctgccatttgctaacagtgacttttaaaataaacatctttattgagatgtatttcccataccacacaattcgcctaaaagtgtataattcaatggcttttaaaaagcatattcaaggttatgtgcaagtattaacatggttgattttagaatattttcatcacctcaagaagagactctgtaccctttggccatcacttccctactctccctgccccccaccagccctaagcaagcactgtctctacagatttctctgttgtggacatttcatatgaatggcatcacacaagtaatctttggtgactggcttctttcacttagcatgatgttttcaaagttcatccatgttgtagtgtgtatcagtccttcattccttttcatggctgagtagtactccactatgtggctatacattttgtttattcattcttcagtggatggacatttgtgttgtttcttccttttagctattatgaataatgctgctataatcgtttacaaatttttgcatggacatgtttcatttttattgggtgtatatacctaggagtggattgctgggtcatataactctatgtttaattgtttgaggaactgttttctcacttgagaaactgtttttctgttttttcacttgggactgttttcccaagtggctgcaccattttgcactcccaacagcattgtacgagttccaatttctctgcattcctgtcagtacccttgtgccatagactttttggttctagccatcttggtgaagtggtatttcattgtggctttgatctgcatctccctggtgacgaaagacgttgagcatcttttgatgtgcttattggccaactgctaacagtggctttgacactggatgctgaacttcagtctttcctcctgtaaaatggtacaaccaccatccatggagcacagtggcaacaccgcgactctctgggctgaggacacatgcgacagcaagtaatcccacagccactggacccagggacaggcagcctctgcagccaagggtcctgtcccttcatgtctctgcttccagtcttttctctgtacgtcctgcagccaggcttgggctgctgcacggctagagatgctttatcatgaaacctgcagcaggtgaaggttctcccagcaaagtttttgcagaaaagtgatgcactaagtgaactgttcttcaaatggtgtgagctgggagtgaggtttctggcttttcagcacatgggtgatgttcttgggtgaacgatgtttccccaaaagatatgtggaagtcctaaatctcagtgcctctgaatgtaaccttaattggaaacagagtctctgcaggtgtaattagtgaaggcgaggtcatagtggcatagggtgggcattcatctaatgactggtatcctcagaaaacaagaaagatttggagacagacacatagacaggggatggccatatgacagcggagtcagagaccagagtgatgctgcccacaagccaaggaatgccaaggatggccacagccgccaggagctgggtgaggccaggaactcccactgagtctgtggagggcgtgtggcctggccaacacactgatttcaaacctctccagaactgtgagagaatacattcctgttgttttaagccacccagtttgtggcttaatttgtgactttgttaaggcagcaatagaaaactgacacaggataatgatgttcaggaatgatgtggagagccctgggggtggttctgttccatgcttgttggatgcttggcatttctggccaccacaatgtatttactgagaatggactctctgcccagtgacagaaaatgagtatggccctggttcctgtcctcagcttagcatgggagacaggaggcaggaatacaagcagcagcttcagaggcaacaccaggcaaggccagggttgttggaggcgtgggctccagccactcccaagccggggctctgaatgtggcccctggtgctctctctggtgctccctgacaaatatggccctgggtgagaaaacctcaggcccctcccactcaaattctgatttgattctggattgccagtgtaatagttgtgattattttctcacaagggttacaggagaccttctgattaaggcaaacatcttgtacatcaaaagctgctcactgtcacccctgggcttactattcatcattctctcttaaatctgttcccaaagggcctacctggcacaggccagctgctgggcccaagtaatatgttttaatcaatggtattaagctttttccatgttctgacattttaagtagataattagactccagtcaccaggtgtccaacagttctacttttctatctggaaaataagttttgaaaatacctatcatgtacacgtttgtatttctactgaaaccacctggcaaccctggtaaaatgtaaaagggaatctctgatctataagaaaaaacaaagctggagagaaatgcaggagctttattataaatcatttaatattcttgaagttaacaactgataaactcatttaggcaaacattttggatttaatgatctaaagctcacagatgcatgccacatctagctaaaagtacataaaaagcgcacctctggaaataacagccctccctctggctgaagactgagaagcattaaggatgcttctggatttctgcagcggcagggcaggggtctgcacaggcctgacctggtgttgctggagcgcggcatcccctcctgggtgctgctccgaaaggcaggctgggaggtgcttgctggggtgttccatggcagcgctgccaaccaagtctgggtctctaaaagccaccctcagtttataccaactgatcaggaaataggtggtgacagggccttgaagggtacatgccggcttcccttaagttgattagatgggaaaccaaacaccgtctttcaagtgtgaggctgtgccatgctccctcagggaggaggggcgctgggtctgaccaggtctgcctctgccctcaccagctggcagacgtgaactggagaacagcaccagaaaggctggtggttggcagctgctcacgacacagttgctgacctgcagcagatcggctgtgggtgagcaggacagtcaggccctccacaagcactgttctggagtttcgtctgactaggtgaaccctctggcttttcgaggacgcagggtaccctactgccaccagccagtgagcagactaggacatctctagacaggaaactcatctaaaaatcggaggacaacctgatgcacccaagtgacaatggacccaggcagctgtgcacaccaggtgggaggcgtttggaacagttagactcatcagtggataggtttttctagcacaaatggaatgtggtgtctcatgtccctagggagacaaagggcaggtttcttatctggtctttccaagctttcaactctctggctcaagtgtcccagaatgaactagaagtctattcctccaccctggtccgtggtcacttccagaactctgaagtggctcaggaggtgactcctgaaaggcagcccttgcttgatctcctggtggagcctgtctgggctgaggcgatgctgggcttgccgtgccgagatctcatgccagaagtcctccctcggagctacctgtctccagcctcattctttggcatgttgactcctggaattgaggggctatttctaagatgcatgctttttcggcttttctcatgggtgcctcatcagcctgcacaggatcccccatctcacgagagagggaaatttggcattgctgttccctgcctctaaggtcctttatgaggggccgcccaaactcattcccttagttcttactctcccacaggtgttgagattttattggcccatactaaaaagcatgcaatgactgaggttttctcctaaccttaatctcatcttctcaaatgtgtgccttcttgtttttaagaccatagacaaggacgtcaggtgactgctgaaatagaactaaagctaaaatttttctcggatcttggcaaattctgctaatggcacctctaggggcacaatgatcctcaaatgacatccaaccagactccccataaacaaggtttgggctggagctgtttctagttttaaatatggaaatgtaaggcaaaggacagagcacttggttttgccttagatttcccagcagagtaggatttgggcgaaactgctggttctctctgtcagggaaataccaagtgcagcagagccggggccatggggcaggctggtggactccaggctcacttgcgtggctgctggatgtgctgggttcttggggaaggatgcttgtccatggaggcatgcggcttctggtgagccacctgcgcagccgccggggggaaatctttgtcaccctgtcaggaaacacggaaagctcaggttaatcaataggaagcatggggtttgtgggtgaggaagccccaggccagtgcccaccagcgtccctgcggaaggatagcaattgtgtgtgaggaagcctcaggccagcatccaccagcgtccctgtaggaagcatggggtttgtatgtgaggaagccccaggccagggcccaccagcgcccctgcaggaagcatggggtttgtatgtgaggaagccccaggccagcgcccaccagcgtccctgcaggaagcatggcggttgtatgtgaggaacgtccaggccagcgcccatcaacgtccctgcaggaagcatggtgtttgtgggtgaggaacccccaggccagcacccaccagtgtccctgcaggaagcatggtgtttgtgggtgaggaacccccaggccagcacccaccagtgtccctgcaggaagcatggtgtttgtgggtgaggaagccccaggccagcgcccaccagcgtccctgcaggaagcatggggtatgtatgtgaggaagctccaggccagagcccaccagcgtccctacaggaagcatggcagttgtatgtgaggaagccccaggacagcgcccaacagagtccctgcaggaaggatggcggttgtataagaggaagctccaggccagcacccaccagcgttcctacaggaagcatggtgtttgtgggtgaggaagccccagaccagcgcccaccagcatccctgcaggaagcatggcggttgtatatgaggaagctccaggccagagcccaccagcgtcgctgtaggaagcatggggtttgtatgtgtggaaactacaggccagcagccaccagcatccctgtaggaagcatggtgtttgtgggtgaggaagccccaggccaacgcccaccagcgtccctgcaagaagcgtggggtttgtatgtgaggaagtcccaggccagcacccatcagcgtccctgcaggaagcatggtgtttgtgggtgaggaagccccagaccagtgcccaccagcgtccctgcaggaagcatggggtttgtatgtgagtaagccgaaggccagcagcaaccagcctccctgcaggaagcatggggtttgtatgtgaggaagccccaggccagcgtccaccagggtccctgtaggaagcatggcggttgtatatgaggaagctccaggccagcgcccaccagtgtcgctggaggaagcatggggtttgtgggtgaggaagccccataccagcgtccctgcaggaagcatggcagttgtatgtgaggaagccccaggccagcacccaccagcttccctgcaggaagcatggggtttgtgggtgaggaagctccaggccagcgcccaccagcgtccctgcaggaagcatggcagttgtatgtgaggaagcccaggccagcacccaccagcgtccctgcagggcaggcgtggactgtgaatggataaaggaaggtggaagtctgtcccttgtgggtgttagggggcctgggcaatcaaaaccagggaatggcaggtggcactgaggcccacacactggcaggacagcaagaatgctcactggctctgccccatgccgtgagacacaggaacatgcgactcccacagaactgacttggatgctgcggggtttcttctgctacatctgtatttgtgactatttaaattgggggcaggacagaaccaaatccaggatcttaagttcagatgtgccaccacagctgtgagccaggcctgggacgctggctgggaaggaaatgcacagggcgcctacgagacagagccaggttcggcctgtccagtctcaggagggactccctattttccagagggatcaatgggcttctgtgccaactgtgggtgtggccagggtggggtccacatgggcaggctggagccacacttctctggctggcaggttggctggctgcggtcacagctccaccaacagtgggctgtccccaacactggcactttcttcaggcatcctctgataagaaagtgaatgttctgagaacagcagccctatggacggcaatactgtggggttcactgcgggggtttgctgatgggagttcactggtgggaggtctgcgcttaagtcacaatgttgggtctcaccagacggcggctctggaaaggtaaaggatgcgagtctggcctgcggtctgcagaagcagcctctggggaaacgcggcaatgaagagagccatggccacagaggagatgagcagtggtgctgggttattccaggtagagtttaacaaaaccagaagcaaccaggagactccatgctgccatgcaaaagcctcaaacccaccgcagacactcccagacttacccgggcgatgaccccagagatgaacacagtgggtttaggtggactggaaaaaaagaagggaaaaggcagatttaacaaaacagtccacaacagggaacacggtggcagacgatgtgtatgtggatgagccaggctggagggcgtggaggcagaatgggaagcaaacctctcctctgcgttatttgttgtaatgatcacactacggggctcgggagcctccttctcctgaggctagttcagccccaagtacgagagagaaacagactgcagccaactgcgagtgaattgccttcaaccactttctatttgtgttttttttagggacagggtctctgtcacccaggctggaatgcagaggcacgatcatagctcacagcagcctccacctcctagactcaagtgatcctgcttcagtctcccgagtagctgggacaacaggtgtgcagcatcatacctggctattttcttttatttttgtagagacagggtcttgctatgttgcccaggctagtctcaaactcctggcctcaagccatccttccaccttggcctcccaaagtgctgggattacagggatgagccactgtgcccagcctatttttgttttttggttaaatcaacacattttaactatgggcaagcccatttatttggatttaatgagatcgtgaaacaggcgcttccctaaagcaggggagaagtagctttacatggtgtggacttggagactttctcactgcctcctcaaccctaggcttccccttccagcgtcctcacaggggagattctagagccaacacaaacctcccgtccccatcaatccctgagcattacaaatataaggtccttgggaaacatgtcacctcttgacatgttaactcacactgagctcacctaaactgccgagtattgagggaatggatgcagtaccaaagcagtacagctcagtgtgaaaaaacagacaagcccaaacaggctcaaatcgccagcaggtctaccacctggaaacacacactgttaacgtggggctatcctcccaggctttccttctatggacagatgtacgtgcttgtcttcttattaacttttttcttacaaaaatagttatactgttttgtaatctgccttctgaactaaggctatggcaagcatctctccatgtaattatatactcttctgtacacttattttttatggctacgtgtgccataatttaaaaacatcaggacacagtttgaggtagtggacaaggtgtgtgcacttccaaatgcctccaccaagaggtacagacacccaagacctggaggtgaatacaaggtcagcccagctgggacagcgcgatcgatcggggacactcacggaggtgggtggaggggaagcatctccctcttagttcagttttgcttaaggccagtcctgctgggtagagggggtagaatttatcccctgagctcaccagcctgtctcttcccagctctgcttctcctctgctgccagtggtcttttttaaggaatccacttgtcttagctttgttttgctgcagtcaaaagtcccagcattccgaaagttcactgactgtttacttccccaaagagtttaccaaaaacacctgaaattcccccaagtaatttctgttacttcgcgacattaagaaacttcaagttttactaagcagcacagagatgccccatacattaccttggttttatttagtgtttgttgtgtggttacccaggttggatttttttccccttcctttacgtacatgatttagctataggattaatagtcggccagaaatgagtaagctcagctcaagtttaaaagtcccgccacgtggtataactgaattcatttggattcttaaagcacatcctgctgtgatggctgataccatccacaggggagggcttccagggattcagggccaaggagtttgcatccaaagctcaggaactgtggtctgaattctaacattttagaaaagatttggaaaggaatacacaaatggcagcacaaagtttcttaacgtcgtttggaatgttcttttaaacatctaggaacagcctgaagcagggatggccccactctggtagcgaatcatatagtatcatcttcaacaaggcacagccgtctttccgtagcaggagtgcacagtggcttccactgtctccatgtcctatttgttttttaacctgctgaggctctgaaaggcggaaatgcaggacatcaccccactccagaaacttgatataaaatgtcatccatagagagtcaatctagtaagaatacatgcataataaagggaattagcttcctcaccaaactgagccctaaaaggtggctgaggaagcttgagtaattatatacatatataaacaccctcccctctacagacacacacacacacaaacaaacaccttgttttatggcatctgcttatcgcacttcacaggtaatgtgtttctttaggaattgaaggtttgtggcaactctgcataagcaagtctatgggtgtccatcttcattattattatgtctgttacagtgatctgtggtcattgatctttgatgttactactgtaattgttttggggcaccacgaaccgtgcccatataagatggtaaacttaatcaatacttgtcatatgtgttctgacagttctactgaccagccattccctgtctctctccttctcttcaggcctccctattccctgagacatagcaatattgaaattagggcaattaacaactctacaatggtctataatggcctggaagtattcaagtgaaaggaagagttgcatgtctctcactttcaatcaaaagctagaaatgacccagcttagcgaggaagacatgtcggaagctcagacaggctggtctcttgcaccaaatagccaagttgtgaatgcaaaggaagagttatgggagaaaattaaaaatgctactccagtgagcactggagtgagtgacaaggaagtaaaagagcattattgttgatatggagaaagttcgagtggtctggataaaagacaagccacaacattcccttaagccaaagtctaatctagagaaaggccctaactcccttcagttctatgaaggctaagagaggtgaggaagctgcagaagaaaagatggaaactagcagaggttggttcatgaggtttaaggaaagaagccatctccagaagataaaagtgcaaggtgaagcagcaactgctgaggaagaagctgcagcaagttctccagaagatctagctaagatcattgatgaaagtggccacactaaacaacagattttcaatgttgacaaaacagccttttattggaaaaagatgtcatctaggacttacacagctagagagggaagtcaatgactggtttcaaagcttccaagggcaggctgactcttagtagggactaatgcagctgatgactttaatttgaagccaatgctcatttaccattccaaacatcctagggcccttacgaattacataaaatctactctgtctgtgctctatacatgggatgacagagcctggatgacggcacattggtttacatcaaggtttactgcttattttaagcccactgttgagacctactgctcagaaaaaaagattcctttcaaagtattactgctgatttataatgctcctggccacccaagaccaagtatacaaggagattaatgttgttttcatgtctgctaaaacaacattcattctgcaacccatggatcaagaagtaattttgactttcaagtcttattatttaagaaataagtaattccactggtagatttgggcaaagtaaattgaaaaccttctggaaagaatttactactatagatgccactaagaatactcatgattcatgggaggaggtcaaaatatcaatattaacaggagtttggaagaagctgattccaaccctcatgggtaactttgagggggttcaagacttcactggaggaactaactgcagatgtggtgaaaacagcaagagaactaggattagaagtggagcctgaagatggaactgaatggctgcaatcttgtgattaaaatcctcagggatgaggagttgcttctcatggatgagcaaagaaagtgatttcttgagctggaatctacacctggtgaagatgctgtaaacactgaaaataacaacaaaggatatagaatattatataaacttaattgataaagcagtggcagggtttgagatgactgactccatttttgaaagaagttctaccatgggtaaaatgctatcaaacaacattgtatgctgcagagaaatctttctttcctgaaaggaagagttgatctatgttctatgtcacaaacttcattgttgtctttttttttttttttttttttttacagagggagagggtctcactctgttgcccaggctggagtacagtggtgtgatctctgctcactgcaacctctacctcccaggttcaagtgattctcatgcctcagcctccagagtagctgggattacaggcacacaccaccatgcctggctaatttttgtatttttagtagagacagggttttgtcacgtttgccaggctggtctcgaactcctggcctcaagtgatctacccaccttgacctccgaaagtgctaggattgcaggcatgagccatcacacctggcctgttgtcttattttaagaaactgccacagccactccaaccttcagcaaccaccaccccaatcagtcagcagccatcaacactgaggcaagaccctctaccaacaaaaagactgagcctcactgaaggctcagatgatcattagcatacagaatttttaaatttttaaaattttaaattaagttatgcattgttttttagacgtaatgctactgtacacttaataggctacagtggagggtaaacataacttttatatgcactgtgaaaccaaaaagttgtgggactcactttatcacaatatttgctttattatggtggcctggagcagaccctgcaatatctctgaggtctgcctgtacatattcattattgaaacgcagacaagcaaaacaagttaaaatcacttgtacttctgtattactgtacgtgtgtatttataaagattgacacacacacacaactactgtcccatcacaactgctgaatggccatggagactctggaggctaaaggagatccccagcaatgagggtggtctaccctgtgagtacgccaccctttgcagaggtggagtggaactccaggacgcagaggcgccatccagcagtagggcgccagcctggagaggcctccatgttgggtgttcctgacaggctccttggttgagcccagccccactgtgtagtagctgccacgtgaggctctcgggggacctggctatcaggaatctgtctccagcactggtcccctgtgtgcactgaggacgggagtctggagcccaggggcctgccacagtcccgcccttcctccctgccctcggtgctcctcagaggtgctgtcctctgggcgtctcctgcattgatcacgacaagggtggggttctatgcctcgagtatgtacccggagaaatgtgtgtgaacagtgatgatatgagatcatgacagctctgctctagcctgagtgctggaaaacacacacggaagctgaggcctagaaaccagcctctgactcccagggcacgctctttcctttcctaaacccacatttagcacctcactcccatgtgagctgctcaagacactgtcccatcgcaactgctgaatggccatggagaccctgggggctaaaggagacccccagcagtaagaatgaccctccccccacaggcccagctcattccaggagtgtccagggccatggttgcaggttgcagcgtctaagagtccacaggagtcattcacagatggcgctgtccttgtgaaaccccaaattcacggagatagctcctttgtgctgagtcatgactgaatctgctgagctttagtggcttggtggattctgctcataaagacagaggatgtcaatgaaaatcatgctaggctcagcataagaaatgtgcctctgccaaccactgggtggcgaggggtgaggtgaggcccaccgggtgtggcgatgagccagggactggtgtcctttgtgctgcatcctatacaaagtggctagtcattctgctggatgtggtgctggcgacttggctgagtgatggcaagactgagggtctgatgccgcagtcaaagggactcactcaggatggaaaggccgtgaacttgcccttgtgcacaccctgagggctgactccgagctgaggagcagggacagggaatgtcactcagtggcaagcttaggtcagagcagtctcttggggcacaaccaaaacagtgtgcattccacctaattaacctggggaagaacaacatgaaggcctgagacttcatcctgcactgctgtgctccagcgcccccatctgtttggcactggtaagaaataaggcactgaaagaaaagaaccccatgtgtccagcacttccgcaggcgaggtccttgctttaagactgcactttttacacaatattcaagaattgtgttgcatgagaaagtcttatcgagccgcaagaggcgactcggcgggaagtgacaggacaccagactgagggtctcctttagctctggtctgctcaaggcaaacgttcttcctaaagacagtccaagctctccctcccttctaacttcgctttgaaaccccagccagctcagcaactaattacaaaaaaattatgtaccattttagccatttttaagtatacagttcagtggcattaagtatattcatattattatgctatcatcacctttatctatttccagaactttttcatcattcccaacagaaagtctgtccccattaaacactagctccccattctctcctcctcccagcccctggccatcaccgtgagtttaactgccctagggatctcatgtaagtggaatcatacagtacttgtctttttgtgtctggcttattccatctagcataatattgtcaaggttcatttatgttgcagaatgtgtgggaattcttttttgaggctgaataacattccactgtacagacagaccacattctgcttatccattcatctgctgatggacacctggactgctgcgaatggtgcagctatggacgtgggtgtataaatatgtgctcgagtttctactttcaattattttgtgtgtaactcagaagtggaattgctgggttatatggtaattctgtgtttaactttctgaggaatcaccaacctgttttccacagcggctgttccattttagattcccaccagcaacgcacatgggttcctatttccccatatccctgccaacgctcgttgttttctgttttgttttattctgtttttttggataaaggctctattctaatgggtgtgaggaagtatcgtactgtggtttagatttagcaactaattttaagaataagcttccctgccacagaataataaatatcaatctgtattgatcattcattaaaggtctttatgaaccaaaagtcgcccccaaaattcttctctaaaactgaaaaggccataattggctgtaaggacatatggcagctgcccatgaaaagatggcaaaaggcaggcctcttccaaaatgtctaacagcgatatgtattttcatgtaacttgtcccgtgacagagcgtatgttgtgttgaaggttttcatcaagtttggcccaaaggcttcagagcccaatccttttttccaactataattaacagcaacttaaattggcaaataattatttatgacgtttataaagtaaaaacagttactaaactctttgagatgtggtagcttgaacaaaatctcacaagcgagaaaccccagtcaaaggtctgggtgtaaggctgtacatgcaaaacacacctattttaaatgccattaggcttccatgcaaagtataacctacatttctcaagtctaagaagtatgatagctgctttgaggatttatttaatctgatgaaaatcattctgacagatgctgttttgaagatgcaacattattttctctcaggaaacagagagtgaaaactatcaaccctgcccgccccatatcctcaggcctttccagactttaaaaactacacttatttaaattgaaaagaactgcaagccaggcagaattagccaggattagaatccagataacacttcctatacactagcagaaactgcagctttttcacacccagactaagcagccacctgatgtccgtgcacgtgggtctctattgtccatctggcaaggaccacatcaaactcttaaaaggaccctttgtccttaacaaaagtttgctattacttattttctaaattttcttaatgaagatttataccttattggcattctgtggaaactgcagacagacaggataaaatgccagaaacgctcagtgactgagtaaccctgtggaatgcagatatcatcaagactgagtttgatggtctcatctttaaaggaatgtggaaagggctgagaaacccaaattcatagttttaaaacttccctaaactcccaaacagcaactatttaactcaatatattcaagttactgctaccccaacatgtaactcatataaaaattgagaagacttttaacattcttttgtgttctaaggctttacaccctccctcatcatcgtggtgctctgacagcctggtttctgccccagttctgagaggtgtaaagcgatgcactcttgtgagttagagctggacaggaggttccctaccaggcagacggctgctgcaatctataccttcatcctttcgcagttgagagcttaagggccttcagtgggggccgcctggatgtctcccaggtgggccggattctgtctccctgcacttagtccagcgcccatcccaagtctaacgctcttccacaggacagtcctttggtatttgaagaaggctaccacaagcccccagaacatccctttcccagactcaaaggcatgatttcaaattccttcactctctcagctattctcccaactgcattccagtgcggtttctagagttttgcctagaactgtacgcgacaccccacatgtacctactcagtccccacaggacaccgatattgcaataatactttcccctgggctacagagagcaggtcagccaggaaatgaatccgggctccccaaaaggaccgattgctagtaatcttcaaataggactgctactgacaggcaacttgtgaacaaagtaatttgtatctgctgccctgctccagcctggctcaccacagctagttttgtggggtccttacccttcttcccttaaccctggagagcttctgcactcttagaaaaatgcagtgcccttcttcaccccaaaataggattctgtgcaacagggagggtccgatgtgcatctgactggtcagcctcttccttcccaagcatcctggtagggattagggtcagcttagttaccacgaaggtgaattctgggatggggagaaacatgcacacgcacacacacacacacacacacacacacacgtgcgtagtagtagtgaaactgggaatctggtcaaatctctgatcccactgaaagtaatcaaaatggcagcaaaggcattactggagagttgtacgtaacagaatcattttcatgttagttttgacctgggttcatggaagtctactcaagttatcctctgcaaatgctgtctccttttcatgtaaatgtactctatcagcaggaagcatgtacacagaaggcagggacacatggcctttaataagccactggtgctctattttccctaaaggatagaaatgatctcaggttgataaaagctactgtttatcaatcaccactatgtactatggaccaggtgctgagttaggcgctccccttagaagtgctgtatctaactctcttggtcctgtgaggcaggaactgtccatttcacagattggaatggtaaatcagaaaggaccagtcatttgcccaagggttgcacagtaataagtgctgggaaccagacttggaacgagggctgtatagtgcatgtaatcttggctccaagcccagtcccctcattttaaagcagagttttagcttgtcttctgtatatgatttagagatgcagagttttaaggtaagcaatctaaatgtaacctgagggtcctttattcaaccagacagtacaatatattcaaatctacctaaagatttactttctgacttgatagtggattttttttcctgaaaaatgatcacttatgtctctagcatttaactagcatacaaagcacttccacataaatcattagctcatctgagttccttcggcaggtgatgttctattttacggaggaagaaatggtgcctcagagaggctggaaccttgcttggggtcctgggggtggagcccgggaggaagcgcaagggctgtgctcttcagtcgggtcgtctgagatctccaccatctcagacgactctgttcctcagtctcgggaacaaaatgcaggggaggcttcaaaccatttaacagattcgaggcagccgacagggccagagacgattcagaaccacgcaaaggagggaccgtggcaaatggacaccatgagtgtgggctagagtgttggatgatccgggttcaaatcctgactctgccagggacaagctggtgagctggtggttgacttttctgaggcttagtttccttgtctataaaactggacagcaacagaccctaccttcttaggtgactctatatatgtgcatacacacacacacacacacacacgcacatacacacagcagaaagcaacagattctaaacagggtcgaaacacagtttccaaatttgcttctaggctgcctggcgggctctgtgctttcctgaggagggtgggcaaagagactgcttttccagggtaatgaccttgagaactgggccgcacctcaaatcaaaccctctgtcagtgcagaagaagaggcccttgggcctcacccactgtgtgctgatgaaaggtagtcacagtgtgtgcttagcacttgtgtaacagagaggacacgacactagagcactgcagtgggaggacagggtaccctcgatcagcttctgcccatacaaagtgaatggggctgggggctcttctcatgcactgatgaagggggtgacataggttgtggcccagcacatgcgctcattgaccgggaaaagcagtctcctcaggaaagcacagagcctgcagggcagcctagaagcaaattccaaaactcttgttttgactctgctcagaatccatagctttgtgcttccagagtttacagaaaatatattcccagctggggtgactttttaaacatttcccagtaagtcgatggaaaacaaatccgttcctgccatttttagttcttgaaataccttcttggcttggtcttaatttatttgggctattaattttctggacagcaaaataataattagcatggctggtgagcagagggaaacgtctcactcgattgcacccagacatttctggataacatcattcttcagagtgtgacagtcgaggctgtctccctccttcagcctggcttcagcactgacaacatttccacaagatggcactgctggtcctctcagcccgcgaacgctccggccagctcagccacctcaaggagaaatggaagccggccaggcactgcgggcgagggctgctggcacctgggcacgagggtgccccttctccccaggagtggctaattgtcacgagtctgaccaaaggcatataaaactcaacttcagtgtcgtaaacacaattctaaacccgagagaaaataatctggaacctaattccttctaaatttggcataagaaatttataacatttttcaaaagggcacaaccagaggtgcttttctaggtgagaatgcttgagctcatgttcacattggtctaacagcaccttctttgcagtgagatgctgttttcatacaactggaatcagccttcaaatccttcagtgaagaggctgggacggcaatctgccccttcctcagaactactgcttccaggacactgtgatttcaggacaaaacttcatctcaacctgttcttctgggtctgggccaggtctgggtctgtgtgggaaggatgctctcatttgggggttctgaaatatttctctccaggtagcattccacccacagatatttggctaattgttgatccagatgtcaaaacttcacagagatttttttttttttttagttaggaaaggctaaacccccaagttctgagtgtgttgggtgaatagggctcatcagtagatgacgtgttccacactctgcatgtagtgtgaaagccacagactgggagtctggtttaaacaggagggaaccttcattttccctctagacacagctccagaaagctcctgtgtgcccagcactcttcccattccagaccacttcagtttctggcgtgtggatcttccctccccctcctcctgctcttccctattgtacccctttccctggatgcaaagaaggggaaataacaacaggaagtgttaattacccttctcacatcttatggatttaatacgtagtgatggtcctgggccactgagagtctcaaaattcatcacatatacagaagcgaccacatctgaggggcacagcccaggcaccacttcctgaaagtgagccagggaatagggggtgtggcgggggggaggcttcagcctggtgtagaaatcccagacattctgctgccatctccacaggagtcataggcgattcagaaccacagacaaaagcagtgtcatggcacgtttgagggcttgggcttaggaaatagatggttctggggttgaatctcagttcagatgagcagcctctcaaagcctcagtgtccatctgtaagatgggaatgattcctactttgtagaatagggagtttaaagaaaataatgtattcactgtgcttggaataggcctccactgacaagctcatgtttagtggcaataagtaatgaattagtttcctatgtaaagacagtctagaaattgctttttgtcttctaaagcataacacttcctttctctctctctcatttctttcaagactggggaatttcagagtttctcagggcttctttgaagaatgccagcgggcccaccttgagtttcctcactcctttgttctaagcattgcgctgtgccatggcgcagggtttcagggcattactatgagaaaaggttcccccagcaccaaagagtgggaatccctgtccacctccactgccagcagcctgaacaattcaaacagtataaagcagcaaaaatgactgcttcctttccttaatgaaatgttccagagaaggtaacttttaggaagaatgtaggttatcattaagggcaaggggcaaacttaaaaaaaagggtgcatgtttaactacatggcaatgtggaacatactggggggaagcccgcctaggcttagctctaaagctacattgttgggagaccttggctgtaggtgggccatctctaaagacgctagatcaggcattggacatagtcctttgcagtattcagaaaggctcctggcactgccctaggaagtgcctgctcaccgtgctttattacatggttagctcgttacaagacagatgcgcggctgtccagcagggcctgaggacaattggtatgattattagtctgtataacgatcatctatgtattaaaaactttacatgttgcttgatttcagtatgtaacatttaccctaaaaaccgttccatctttgattctgaacacgtccacgctttagagtcactctttggaatttcaattatggggaggtgctggtgactgcttaatgctgattagacaggtgctttaaaaatcactctatttattgtctatattttgaaatgcaatcttcaggctcaagggtcatgttataaatggtttaatttttgggaggtgggtgtccatggttcaaagtacaaagtattttaaataggataaaactatggtggctctaaaaaggaaaatgatcatgtaggtagaaaaaaatccaacaagacaactgtcattggaattcctattagaaagaagtacacattaatccaatacagacaccaaaaaactcatctggtctgagtctacttccatctccggaagcacaggtggctgaccttaaatgggaccagctgtcactaggatgtttttgtgtcgaacccagcaacagaattagagagatgccagagttaacttgcactgaggatactttccagccaggtgtctggctggaaagtcacagagctacgcatctagcaagaatcaaagcctggcctgtgagaaccacgcacagtgtggactcaggtcagggacactgcatgatggacaagggctttctgaattcctgaattcaccaggaattatgtccttagtccacctttcccacacacagcaagggagggagttggtgagctgagagcacagctactcaccagccagccaggctgatgcagtaagtgtcctcagtggtctctggatctgcaaattcaactgctacctgactggaaatgctagctctggggaccctcctaaggcccttcctcagatcataccaagcacttgggccttttccagacttagcaaaaaaaaaaaaaaaaaaaaaaaaagagagcaaggtcaagtagacagaaaactaaactcacaaccaattctgcttactttccaaaaccagctagtgagttgggataacttacgttcaacccaacaaccctaccttcacccacgtttatagcaaacaccgccgagtattagaatacaatgggagcgcagcagggcaggctgtggtatagaccagcatcaaaggcccctaaagtttgggtttcgagaaatgcactgtgagccactaattaaagtcttcactcactccctgatattgactattcatgatgccctgatctctagtgactgggtctctcctgggtaaattaatattcagggccctaaggtttattgtggtttatttattagttggtttcattcatttattcacacacatactatacatatatatgtagagtgtcattctatctatcaatcatccatctatctgtcaacaaaagttctctgaaaaaggaatttggaggaaagagactttattccagtgaacagtttgcaaaccagggagacacagcctccaatataaaatgaaggtatgttccaaagaacaaaggaagacttgggttttagagcaaaagttcccacccaggttcccaatcaggtctgtttattcaaattaaaaaaaatgaaatttgcttagttctgattggctgatacggctgagtactggttggttggttcaggtgagctctaaaagtcccaaagataaaaaggtgcaggtttgggggggatctcagcatacctgtatgacccctagtcggcaaatggccacttggctctatttcaaatctggacccagtgagccactaaggatctatattggaagactggcccttccaggttcacatttgttcacatctacctacctacctacctacctacttacctatctgtctgtctgtctacggtgtttataagtatcaagcatgcctgaaaataaggaagcatttgcacaatctctggagcatctcctactttttcctgcctgtccagttgctggagggacataggagcttgtctccgcttcttatcactgtcatcttcttcctcctctccactaacaggcatttggtgttcacacactgtataggacgctgggttagggactgaggtgaagactggtcccagagggctccctaaatagcaagaggccaacaggccacacctgtgaggtttaccagaagctaatgcgaaagcaggtcaccatgggtttctggaaaagtgggctgtctctattttgatgtggccggtctctgtggcaaccccatgaaaactaagaatgtccttattgacaggaaggacttccacaagactgatcctccatcagggatgagaattcccccagagctattcctgaggacatgcagggaaccacagaatctctgtgaacttggtgaatgagcctttccagagaggaatgaaagggcaggggcaggaagcaaggggaattccagagtgtgctgcactaggccccaggcccacggctctcactccttcctgcttctcccaaaggttccctggggtgtcccctgccttgagggagcttcctttgctttccatgaggacagccagataatatgctttaccaccagcaaatctcaccagtgaagatatctatgtgccctgttattcacaaagtgaggaggcagatgctggatgatggacagagcaagctgcgaccctgagggcccctctccgagctgagatgcacctggagggcacaacctcgagcatgaagagggtaaccagaatggggccctgggtgggcccctccgcgggcaggatgtgacatacttctagggagcattagggctcaatggaaactttccactaagacgtcagaggggaattgatgtgtagtgtataatcctcactttgaggcgctatgtacacgtagacatctacatgagagccttccttcttccacatggctgggcagataagtccacccacctgacttctgaggcccactgagaagtgacagaaagtgcaagaacaacacaggtgcatttcaggagaactgccaccaccatctctaaggacagctgcaagccaccctgcaaatgttaatgaattagaatgcaaactaaggttggggccaaaggaggaactggaggctctttattctccttttcacatctgctgggacctgtaggaaggggagtcgttagggatgggagaagggaaggaaattttcagctgaggcacaggttctggtggggagttctcactggcactgttgcgccccaggggcagcgtggatgtgtggggcatggtagtcagcgtgcatggatctgtgctcaccaccactgtgcctgggcgcttccatcaggtaaatattcactgagcaaccacccagtgcctgcccagtgctgggtgctggagacccaggagccaccacccagatggggccggccttgctgcggcaagagggtgctgggctctctgcagcattataggactcaaggctgacttgacctgctttgcaaactaacccagggcccttgtttctctgggtcacgtgctataggtaagatggccctactgttttacattctgttatctcaaaccagaatacattggctgaccagcacaaggcagaatgtgtgaaaacagaactttcccagaaaatctgggccatggggcccctgctctgaatagacgggtgtgaaatgcctgtgtctgtgctgttccatgcatctgatgaacaagctgtcaccttagaaaccagagggaagaagcccacagagaggtgaacacccaggaggcaaaccatggcatctggctggggcatccgggtacttggtcaagacctgaagcaaccattggctatgagggcttatttcccaaggaaacaaaaaacgcagtgtttaaagtgagatacatgcataaagcacccagagaagtcatctgcctctgtgttgcttgtttaataaaggcaggtgaagatggaacaggagcactaactcacaacaccgatttaaaagaagtcagctgtatcatggagaacgcaagtcaaagaggagttcttttcaagctcaagatgcaatctgctgcttttcctcagcatttgcctcaataaggaaccaatttgaatatttttaaacccagcatctttatggttcagtaacggggctgagagccctaaaatggttttcaaggatgtaagtacaaacatactgtgcattgtagtttccaataatgattgcaatgtcagatgacattgtatttgtcttctatcagtttcttaaaataaataaataaataaaaaggttgagggggacggggggcgggggggcagtgggtggtgcaaccaatcccctgccatctcgtctctgaccagtagagggagaatgaacttcattcagggcagcaaattaggcctcaagttatccctaggatgatggttatgtccctgattccctgggacggtctgggttcaggcattggtcctggtgttattactagcagtgctttctttcactctcaaagcatgtcagactaaatatgctgcatggtcactccaagctgagacacagaattctggtatgatcctcaacttttccgggacacttaagtttcatttttcatggaagaaatgctcggattgcctgtgcttggttccaccttgatacttgagccagctgataaacagcaacttcaaggctggctcatgttctctttccatcactttccttcccctccaagggcaggacttatactttcccagctgtgttgccataagaacttcccaacatggctttaggcttatcacaacacagctttaggcttctgcacgcatggctccccttcaaggtcaaggaccatggtggaatttgttgtgtgcccagcgcctggcacatggtctggtgcgcacacatactcaacaaatgctttgagcaccaaatgacatcaccggtcagcgaccctcagcttagcacaagtttgtggtcgtggccaggcagtgaatgaaccagggtgcttagctggaactgtttgttgctcatttcttaggaatgagtaactctcatgccctgcccgcctcaaaggcttgcaaaagaggcaaaagagcgattagagatagtggatttatttttgtgacccgacaatctggctgagctggatctgctggccatgggttgatatctggagtccccaagcaaatgggcccttcctccagcttttgccagactgacctggaagattggcttttctccctctttagagggagctcaggctaacaggtacttcttcagatcttttcaaggcaaacttgagaatggtgatagagccatgagctgaagcttaaatgataagcacaattagctagaggcggtaaggaaaagagggatggggtgttatcaatgaccacattcacgagcctgaattaacgaattcaacaggaaaaactccatctaccttctttatggcaactcctggcagctgccaacaacagctggatggctttgcaggactcttgcctaaaccagagaaagactaagcatcaaaggtagctcatcttgttaagaaagcatgtctttttaataaagtgcgatgtcactcatgaccaaaaaaacccttgcaaaagggacagtaacatgcagacagatgtgcacccttaccctgagcataaacgatctggcatgccttgcctcctcagccagagtctcaaatgcctgaagaatctgggtcttaagttttcaactttcgtctccttacctaaggctactccacaatttctgggtttagtcatctgcaagtgaatgctgggaaacagcctgtttctgttgattccccttatcaccaagcacctaggagcagggctctgtgaggaatgactcactctgggcagtaggacacatcttacaaagcaggggtgctcccaaaatagggagcttacttgttgggacacagtaagatgtttttccctttagaaacaatatgaatgatgcttaggttcctaaactgtctcagaagacacgtaatccaagtgtaggctgtgaaatgctagtgtgctgagttggggctgagagctgggcctggctggctgtgggcttctacagagtagttgcagccctgtgcacaggcagggggggtgtcaccgactcgcatgtgggcaggtctttgctgcgcatcaggtgctttaagcttcggaacaactgtgcaggattctattttagtattctggaagcatcattgaggaagtagtccagtgaagttagctctaaaaaaactctttactctaacaattaaaagaaatatgccaaaggatccataagggatgaataaattattaaactattaagaagttgctataaatatgcagtgttaattcaataattcataacggactggtacaacaagattttttaaggctcataaaatactgctggctttggcagtagctagtgtcctggggctcatgccaattgcttctttacacagcagcctgggtgtggggggcacagggagccttcccctggctggctgcccaaggactccaggtagaggacagcgcagggcgtggctgtggggatgtgccttcactgcctctccagccttgctgggggccaggcactggcttgtctctatggcttcacaaaaaatacagcagcggtgaagagggggagaattcacagcaccatgctgtggcagaaagcagcatcccgagggctgggcaacctcttgcctgaacctgggaacagggcgtcctgcctgtcaaataccagccagcctggtgaccttcatctccacaggtgcctttgtaccccagagtttcctttatagtccctgatctcttttacctggagcccttggggctacataggtttcagaattcaggatttttcaagttttataaaggcaatatgttataaaaatcatatatagtgaacagttctggaggggcttgggcagcaccccatattcaaacccattaatttttctacagcaaaatgtatggatattacactaagtaggatttagggaccataaatatcctcacatcagctcaatttttgccaccatgagtttcagtgtgaaaacataaagccctctgcagttttctgagtgctctggaatgtgtatttgccttggagacatgggcactttccgctcaccacttcctatgtgtctctgtgctgtcgcccagtctgctgccaagaaagggaaatggattagaaacaggtaagacggtaaaactgtcaggaggtaaaaagattactcctggattacatggagatgccatggtcagctctatacacttatctgtatagagtaaaattggattcattcaattaagtgaaacccttggcaaagcagaatagaacaaatgtaatcagggaattttccccaaattgtatcttggtcttttctgggttaatagaactgagcaccaacacctgtcttctgtttgtgtggcctttcactgattctagagcccgttgcctgtgatccctcagtctttcctgcgcagtgtacagggccaggagcccacaagcatcactgacctccttttcatacaggtgagaaagcagcttagaggtagacagtccctgtggtcgagggaatgggaggaagtggagccaggacaagcacgtgggtcctcaaactttctggctagctctggtcttcctacacctgtcggatgcacaacctcagaattgtggcccaaaatacattctgcctggctctcatcctgcaatgcaatttgagtagcctgtggtcaactaaattctggaaacactacttcctgtatcctcctctgagagactgaaatgccccttagtgtaatggggctctgagtcatcttaaggaaaccagattaacttcctttcacccatttcctgatgcgtttgaatcaggaagccttttgggcagaacttccattagcatcagcccaccgcggcccacactacacacggtcgtgacacatgtattaaaggctgagttgcaattgtgttccatattttatgtagaggtgaaggtggtttacacattttggaaagagttttacctcggaggctaaataggggtcacagtgatctagtgggaggcccaggctagggaatccatttctccatcctccttttctccaccactgggtcacgtgctgtttggtcactggaaggacaagtctgtgtggcagaagcctgggctctctccactgctgtgtgagaacaaggctgtgcatttggccccagcctttcagctgccttgtcatttgtgatgaaacagaagcagttccatgcagggccacatgccctcatggtgtgtactatctgggcgaaacctgtcagacaacgggcatttttcatagagaaaggagaactcaactttggtctaagatgctctctgccctcctgcagttttcctttcctactcagtatcatctttcatggggagagaagcagatttaaatgtaaggtgcagtcatacctttgagtgctgattttcttttgttatgatttgatatacctatgtgttgaaaaattccacaaattatgaaatccttggttaggtgggtatgctggaccaggtgtgcttggtgagacattagttccatgagccataaaaaaagtgacattcctttggggatttactgcccctgaatcatgtgagagccccagaaacaaagcatttctcaaatatgcatcattttaggtagatgagaaagaagccacagtcacctccgccctctggactgcagagagcttagctcacatcggcatttgcatccaacagcacaacatggaaagcagtacacaacaagaacaggcagaagtgtcttcataaacacattttgcctaaatattctgtattaaccacagccatccacttacagggtgttaggataacttttagttctaggtgcttgactataaaatgatggcgatacatcaactactaatgaacatactactaataatagctagtatttctttctgactctgggcccagaactattctatgtactggagacacattaactcatgtaatcttcacaacagtcagcttaggtaatattattaataatcacagtttacagataaggacacatgcacagagaggttgaataacctgcctaaggctacacagtgagtaagaggagaagctaggaaccaaactcacaagtgtgacaccgaagcctgggctcctaactgcagctgatgctttcaaatccaaacctcaaatgcattaatgccttatatggcttgggcacaatcttgagaatttattcaaatgttacctggtttgtcagaaaatcggacagagatggacttgttaagacaaactcactttactaatcagtgacgaggcagttgagaaacattttacctggaagaatttcttgtctcttgtttatgagacaaaaatgatgatcggatttgataaagacacacttttactaacctagaaacagtatccaaatttaatacattaaattgtacctaatgaagaggccaacagatgtgtgcacctgatcctatgctgtaggtgggagcactgccctcgagaaaagggctcagcattccagaaaagcccagaaaaacccgatgcacacggcatgcttcaggtccatcttcatgaacaacacgaacatcctgtgtcctcccctaattaggtaacctggtcacgcgcttcctcctttcttgatctgaattcccacaactataagagggaaggatggcaggctaagttcaaaacccacatggagaagtcagaggggactggccttaaaaaaagccatgggtctgtccccaagtcagtcggccagtttgcaacgtctgaggtggctggggctcaatgtcaaatgaataatgaaaactcaactgggcatttacatttaagccaagtgctatgaaggggaaggccaaggtgctaaaggagcacacagcaggggtttaaactggtttggagggccagtgagatttcagctgatatctgaaaggtgtagcttagtcagctgagcaagtgttgagaggcagacatgtgggtgggttcgggaatgggagaactgcccaagggtgcattctgccttttctcaacagcagcacaaacttgagtaatttaaagattcatattcaaaaccccgtaacaatgtggccccagcactgagctgagggcaggagagctggtggtgtgatgcacgggtgatgtggtgcataaactatgtggtgcacaggcagtgtgatgcataggtggtgtgatgcatgggtgctgtgatgcaggggtggtgtgatttgcgatcagtgtggtgcacaggcagtgtgatgtgatttgtgagcagtgtggtgcacaggcggcgtgatgtacaggtggtgtgatgcacgggtggtgtgatttgcgatcagtgtggtgcacaggcggcgtgatgtacaggtggtgtgatgcatgggtggtgtggtgtgtgggtggtatggcacacaggtggcgtggcataggaatcatgtgatgcacaggtgctatggtgcaaagatggtgtgatggatgggtggcactggatgagtactggctctgctcatcatccagttctcttttagattaaattctccatgaatcacattaatttggtgcctcaccccatgctgtcgctacctccaagtggctctaattcttatttaggcttgaaattcttaagagttggatgctacactgaagagctgaatcatcctttaatattaagtacaaaggaatttcacgggcaatacaaacttgagcattgttacaactccaggcagatataccaacaggcagattataaagggcatatgctgtcagagcagagaaataacttgggagaatataaactgaaatgaccactttgaggaggaaaatttttaaaccaaattattaattcttctctactctggaattgcttaaaagattttctatcaaatggctttcctacattttcagtatgacccacaataaaaacctggatcattttacattgtgatgcagtgggcacaagtgcacacacacacatagagacacacagacacagacacacacatatacacacacagatacacacagacgcacatacacacatgcacagacatacatacacacacacatgcagacacatacacgcacacaggcatacacatatacacatatcagacacacacacacacacacacacgcacatatctccctaaacaaacaattctgccccttgtatcctgggatgcactaatcccatgtaatatgggatctgtatggtcccatccctgctgatctccatccactcaactgacttcatgacccaccaacgggctatagcgtacagtgtgaaaagcacagcgactctgaaaccatgttattaatgataacagtttccacacttccacttttctttgtcatcgtaagcaatgggggaaagtccttgtgcggttgtgcaggtggactcctacactgcaggcccatataggaatgcgtttggggtcaacagataaggctctggatgctgtgaaatgttctcagcacctctaactagggtgcaggagcacaggagcacagctgtgcctgttgttgggtgagtgatttttctgacagagtaaaaccttatttcgttggatttcactaatttgaagttcatgttcattgggtcaaaggttataggcaacataaacaagatagtagaaagaatattaaaatcaaaagaccctcaatctacaaataattgatacgttcattacaagtaatcctcctttgtgctttcagtcacatctcctctacgaggaattcacctggcacctctggaatagacaagcatgtgccatggcttgatcatgaaagtaccaccatatttctttgtatttaataatctggatttttaaaaagcacatctgactaccattcactataattaacacaaatagctgaagttctactgtatgaggtatgcattataaatgtttttaggtttgctattcaggacgtgtacatgcattcctataaaaacccaggtgagttactggggaaagaagatgaataaaagtccgactatgcgatgctgcagccgtggagctcacacagtgtgactactgcatggtgtggtgtgccagacccaaacgcaggacactcccagagtaacgaggtaggtaagggagcccagtacatcaatcccaccactggggagagcttggaaaggattttcaattccaacctcattgcttgggtgtgttcaaaacatcccactgcactgcccagagggttgcctcgtggtcagatgggtttggcaaatggttaaacagggctgtgtggctttctccgaggcatggtctccaggccaggtcacaagctaaggtgcataatgaatttccaggagagaatcctagaggctgcttgcctctgaccacatgacaggaagccaaggagcaggcttggaactctgctgcacagcagggctcccaccctccacaagggcattgaaaatgcgggcaatggaccagaggctgacagttacccacctggaacatgtcccagggaatacccccaaagggaagagtgctgggcactgcagcccttcttgtattctttagggcaatgatgtcctgggacccagggcatcggtatggattcacctgggactggtcagaatgcacatttctatatactacataagccttcctcaaacacagaggcccagcgatctgtgtgtaaccagccccaggtgatgctggcgctgctcgaggctgattgccaggctctgtgatgagggagaagtgcccacataaaggggctgcctgggagtttccgtcacctccaccttcagaaacaaaacagggaaaaatcacttcctcagcaaacgacccctccccttccctcggctacaaaacaatccagccccgaagcctcagggagaggtggctagggcccttctgagggcctgcttttggccaggggccataaggaagccttcacagcctcaatcacaccaaatcccctgaaaagtcctgtaaacggatatcacaggcccatctccaagatgagaagctgaggctcagggagttgcagttatctgacccaagccacagaatggccctggcagaggcaggtttagctcctgttctctgtgttcaccccactgcactgagaggcctcctgggaaacgtgtccacagccccaatacggacagaaccatgagggggccacagaagcctttcatggggcttagaggccacagagcgctctgagtgaggtcaggaggcctctggcatcgggcctggaagtgtggtgggatgatgggtgtgctctggagggtgcagaggaaggcacgagggtccacaccaatggacgggctggtgggaagcacagagcctgggagggtggctggagaaggtgccctgaaggcaggacgtgccttgacttctgcgggtgacagggcaagcaggctgggagtgtccttcagccctgcacctgtgcctgagtcccaatcaccgggtgttaagggacactgtggagtcagtgagaagcaggtatgaaagggaggggcaaatggaattgtctgggacaactgaaggtatctcaggcatctgcatcaagctgcccagttagcaataccaagctgagccaggggaagtggtgagggctgaggggttgtccgcagaggcacggtgtgagaaactgtggctgaaatgaatttaccctggagtgtgttgtgtgaggacagaagagacaaagagaaaaggcagtgcagctaataaataacaactgaggtctttaattaaacatcagtgaatctaagacttgaactcttgaaacatctgaagttgtcaacgtgaaataaatatggccatggggtccacactcccatgttttgaaatgaggggagagaaaagggttttgctctgctgtacacagcaaggggaaggtaggtgtgagcagacctcgggatcagcagggccaagagcagcgcatggctcccagttggtggctgaagtccgctcacccggggtggcctggggcttttaccttcatcagaatttcatttgaactttgccctgatgccaggcgatccatgtctgcatccaccctctatgaaggccagcctcagacagggtgggactggagacaaaggtggtctcaccggggcgtaactgccctggtttgaggaaggagcagtgtttacaggattctcctaatgactgcccccacactggtcctctgaggacacacgtgcacctacctccagcgtttatgctctgtgagagccataacttctacgctctcttactctatcggcattaaaaatcctctgaactctgacagcgcttcctgtgtttcctggagtcggtgcttctcaccaccctgccctccaactgtctatccccatcttcctgatgagacctcagccaccttactctgggtgggacgtctgtttactctttctcacacagtgctctgaatagagcctcaagaactgctgattcactggcttcattaaacccaagtttgggactcaagagcaagttagtttttcattgaaaaatgacatgtgtctagcatttgcaagcactgcgtgggtacaaagtaatatactacataatccttcctcaaacgcaggaccaggcagggcaggaaggacttgaggcaggcaaccactgtgtgccaagtgagaggctgttctggctgaatttcacccccgtccttcccagcaacacattcctatgttgaagtcctaactcccagaatctctgagtgtgactctacttggggacagggcctttaaagaggtgattaagttaaaacaacatcattagggtggaccctcacccaatatgattggtgtccctataaggggagagcaggacacagacaggcagagagagaagactgtttgaggacacagggagaagacggccatctacaagccaatgagaaaggcctcagaaggaaccaaccctgctgacaccttggtctttcaacctccagaactgtgagacagcaaacttatgctgtttcatccacccagtctgtggcactttgttaaggcaaccctagcaaactaacacagcaacacacacagcatgtgcagaaagaattcggatgggggaagctcctgtgggctggggtcataaggtaaggctttgaaaaagccgcttcagtggggcctggaaggaccggcacaattcagggtatggagggactgggagacccctccacataggaagggcaggagaggtgcagaggaggactgagcacggtgtattctgccgagtagattctggcctctcaggtcctgattcatggaaaaggtagacattgatgtctgtgaggagggctggatggggtgggggagactgggcagggccttaaatgaccggttacaaagggcaggaacccacaggaccaacatggcacaggggagagagttctagactagggcaagggaagccctgtgggtctacacattagccttgaagctggcgggaatgcccttagcttctcagggcttctgttattcagttgcagaatgactacattgaactctttcagtggttatcaacttctctgtctgtagcagtagatcctgttttaaaacatcaaatctgaatggaacctcaagatatcaaatggatctaggtggggctcctattgaagtgggggagggagaagcctgaggtggaccccaaggcatctactcattagtgcaggcctccatacgacacatgtacccatgaactaggctgagggaaaaccaaccaaccagccgaccaaccagccaaccaaccagccaaccaatctgccttacatctttatctctgttgacatctgactgatatttaacatgccctctcaggatgaactccacaggcaaccttcccaagccaaaggctccataatcgattcctaggaagcaaaggttacagggtggggaaactggaatctcagcaagacaacctaacattggaatcgaaggtcaactgactagggcaagactgagacaaggtgaccagtaagaggttctgtggctaaccaagtctaggatctgtggcagtcagagcagttccttgtgggagttacgttccaggcacgacagcaggactgggctgggcagcagaggaggagatcacaatgactgattttcaagcccaggaggagcagggaatgagggaggcagaagagtgaaacagagaaccaccaccaacagccattcataacgtgctttatcttgctcaaggctggcatcttctcatctgacaggggttactgttttacccccactttccagctaagaagcccccctgagagctgaagtgttttccacaatcacacaggcaacaggtcccaaagctggtactcaaacccaagtctcctgccccaagccctgtgcactccgtccactagaggctgaggtaaagctggaccagcaaggagccgtccctccagccagcaggcacgcctggtgtgctctggcggggaagcggggctgggcaagtgctgctgtgtttattcctcattcgggtgatgacaaaggcgggaacatgcaagttctctaatggacggtaaacagaagaaagcagaggtctgagaactgaacgtcagggagcagtcaagatcccatcaggctgcccatgtatttcctcttaatatttgacaatgaaaagggtaattaggactcgcagcaaagcagccttgcaatggaatcacttaaactaggccgtgggttctttccacatggaaagggcatatggggtgtagaaccgtgagagtcacgctgagatccacacctttggaaagttgtctgatgtaataaaaaatgagagtagacatatatgttttgacgtaacacagatctaggaggtataaggtaaagattcttaatctaatgggcccagaaataaaattcaggacacccatgaactaggctgggggaaaaccaaccaacaaaccagccaaccccacatctttatctccactgacatctgactgatatttagccggccttctcagggtgaactcagcagcatcagcagtgcctgtaattttttcatcaatagaaatcacagatattaatagttttatatcacattcctgttgttgcacatacctagaattaccgttgacattcatcactactctaaagtgatggcagtgatcagacctatcaggagaccttgttattaaatcttaaaaaaaattacaatttaaagtaatattttgataactgtacctcatacttcttacggcaagaaaacaggtaatacaaataaaaacaaagtcaggaaaaatatacagaaaaaaattcaaaaggatttgaaaagtgaggaagcatagatatgcagatacatggtgatatggggatctgtgtcccaccaattctcatggtggaatcataatccctaatgttggaggctgggcctggtgggaggcgactgcatcatgggggtggatttctcatgaacggtttagtaccacccccctggtactgtcctcacagttgtgagtgagctctcgtgagacctggttgtttaaaagtgtgtaatacttcccctcttgctctcttgctcctgctcccaccatgtgagacgcctgctccccctttgccttctgcctgattggaagctccctgaggcctccccagaagcacaagttgccatgtttcctgttcggcctgcagaaccatgagccagttcaacctcttttcttataaattacccagtctcaggtattcccaggtatttgcactgctatagggcaaaaatggactaacacatacgaatatacagatatgcacgccataagggtctctgtgtcttccagagttgtgccacaaatgtgacttaaatttgcttgtgtccaaagtgcagggagttatatggacagttgctgagttcctgtttttggaggagaggaggaggccccaaatgtaaaatgttggagaggttaaagacacagtagcctgatgtcccttgggtttggtccttggaaggatgctgctgtacttgcactagggagtatttgtgaagtaataggaatggcagccagattacagggcccaggacagcaacaggagcaacttccaacccatcaggctgatgccccacccacctccaggtgccactcactccagttctaaacagtgcctggccacaccttgcaccactccacccttggggacatggagtagaagcctgagctgccgggggcttcctacagcaaaatcttctgagcttgagaaacgcaggcaaactggcaatgtcttgtgggtcaattaccaggcagttcctgaagacccagcaaaggtacttttgaagaagctgctgggtcatttctaggtacatagcacctctcagaagcaaaagaaaaatgctaagaagaattaacgcagttgttaggaagtgagtgagttaactaaggtctcaaggaaaacaggggtgagtcttccgatgccacggagagaaagggcaggctgctgtaggcagggaggctgttagcctcatttatcattcatgccccctggccctgggaactcaccatggaattccaacaaggagctggcactgaggtatttattgctttctttgcatgtcagcttgtcacacgtaacaattaatttgatgatcccaaattggacctgacaggaaacctctcgataatacaccatgcctagatttagcagagataaacactgctgttaatttctccagcagaggatgtgagtatcaacccagggctgctttcattaatttccatctcacacaatgtgggcccacctcatattggcattgctccctttagctgatagctgtggccagttttagaagtgtggtgtcctagggttgcctgccaatcatttcccattttcaaagtgatgagaacgtgacaggggacacagacattgagctccatcggtgaagaaacagcgggcagaatgaagctggataagccctgaaactgctggtaagaagataaaatgcgactaagagaaattgtgctttcaatgaacttttcaggaacacatctatcgtgcagagtaaactccttcgaagtctagatatctgtgggtagtaagaaaaaataatattttttctctccctccacccctatactaactgtgatggttagtactgagtgtcaacttgattggattgaaggatgcaatattgatcctggtgtgtctgtctgtgagggtgttgccaaaggagattaacatttgagtcagtgggctggagaaggcagactcacccttaattgggtgggcaccatctaatcagccatcagcaaatataaagcaggcagaaaaacatgaagcaagagactagcctagcctcccagcctacatctttctcccatgctggacgcttcctgccctcaaacattggactccaggactccaagttcttcagttttgagactcggacctggctctcctggctcctcaagcttgcagacagcctattctgggaacttgtgatcgtgtaagttaatacttaataaactcccctttatatgtatgtatctacctattagttctgtccctctagggaactctgaggaatacagattttggtaccaggagtggttgtagaggaacagaatattaaggatggagttctttcattggttttggggtttctggagttggttgcttaatatgattagaccccaaaatgctaaggactctgcttctaatagtatggagaatactgataagtcctaggcggaaactgtttagacttatgcaaaataaatgcatttggcactcctgattcaccgcttgtgagaagcaaggagttcactcactctatacataatacctttgaccatatgtggagaaccaaggaacataatgcagcttgttggttgctcccaagttcagtggacaaactgatgaaagaaaatgatgaactcagggattctgtctccgggcttcagaagcagatactgaacctcaaatctgctaagattgccctgagtgagagtcttacctcctgtagagaaagagctgaaattgtggaaaaacagacacaagcccttatgatgtgagtggctgacctgaaacaaaaggttcgtgcacagcctcgccaggtgtctactgttaaagtgagggcattgattggaaaagaatgggaccctgcaacttggaatggggacatttgggaggaccctgatgaagctgggcacactgagtttgtaaactctgatgaaccatttttgccagaaggaatttccctattcccagtagtggcaacatccccttcccgacccatgctgccaccagcctttgcacctctgtctgaggagataaaccctgcgctgcctgagggaacagtgatgacctcttctgaggcagttgccaggcaagataatgttgattctcctcagaatccaccccaatacctctgtttgctaattagataccaaggtggcaggggccaagtggcagcactcgaccatcaaaggcaaggtgggtgcagctacgacaatgaacggcagaggcaatgaggcaatcagaatagtctgactagtgtagagctatggcattggctaattaatcacagtgttcctagaagtgaaattgataggaagcttactgcattcctacttaatttatacaagcggaaagcttctaggtgaaatggataaaagactaatttgaattagaaaaacagaatcacggctcctcaatcaatttccagacttgagtcagtttacacacccagaaccccttgaatgaaggggaggctgggtccccttgaggaaggaccctactacattaccaacaatttatgcaacaaatctttctcccatctttccccaaggtgacctctggctttttaccagagtaactgtggattggggaaagggaaatgatcagacatttcagggactactggacactggctctgagctgacgttgattccaggggactcaaaacatcattgtggtcctcagttaaagtaggggcttatgaaggtcatgtcattaacggagctttagctcagatctgacttacagtgggtccagcgggtccctggactcatcctgtggtcaatcccccagtgccaggctgcataattggcataaacatacttagcaggtggcagaaccccaacattgactccctgactaatgaggtgagggctattatggtgggaaaggccaaatggaagccattagagttgtctctatctaggaaaatagtaaatcaaaaacaatattgcattcctggagggactgcggagtcagtgccaccatcaaggacttgaaagacgcaggggtggtgactcccatgacatccctgttcaactctcccatttggcctgtgcagaagacaggtggatcttggggaataacagtggattatcataagcttaacctagtggtgactctaagtgcagctgctgtgccagatgtagtttcattgcttgagcaaattaacacatctcctggtacctggtatgcagccattgacttggcaaatgcctttttctccatttctgtccataaggcccaccagaagcaatttgccttcatctggcaagaccagcaatacacatttactgtcctacctcaggggtatatcaactctctggctttgtgtcataatcttattcggagagaccttgattgctttttgcttctgcaagatatcacactggtccattacattgatgaccttatgctgattggatccagtgagcaggaagtagcaaacatattggacttactggtgaaaacatttgcacgccagagaatgaaaaatcaatccgactaaaattcagataccttctacctcagtaaaatttctaagggtccagtggtgtacagcctgtcaagatattccttctaaggtaaaggacaagttgctgcatttggcccctcctgcaaccaagaaagaggcacaatgcctagggggcctatttggattttggaggcaacacattcctcattttgatgtgttactctggtccatttatcaagtgacccgaaaggctgtcagctttgagtggggtccagaacaggagagggctctgcaacaggtccaggctgctatgcaagctgctctgtcacttgggccatatgacccagcagatccaacggtgctggagttgtcagtggcagataggggtgctgtttggagcctacagcagggccccataggctaatcacagcagaggccactaggattttggagcaaggccctgccatcttctgcagataactactctccttttgagagacagctcttggcctgttactgggctttggtggaaactgaacatttgactatgggtcatgaagtcaccatgtgacctgaactgcctaccatgaactgggtgctttctgacccatctatccataaagtgggtcatgcacagcagcattccatcatcgaatggaagtgatataaatgtgattgggcttgagcacgtcctgaaggcataagtaagttacatgaggaagtggctcaaatgcccatggtctccactcctgccaccctgccttctctcccacagcctgcactgatggcctcatgaggagttccctatgatcagttggcagaggaagagaagactagagcctggttcacagatggttctgcacaatatgcaggcaccacccaaaagtagacagctgcagcactacagcccctttctaggacatccctgaaggatgcagtgaagggaaatcttcccagtgggcagaacttccagcagtgcacctggttgtgtactttgcatggaaggagaaataatcaaatgtgtgattacatactgattcatgggctgcagccaatggtttggctggatggtcagggaggtcattccaagcggtctgattcaccgtttgtgagaagcaagtttattgactttatacataatacctttgaccatatggtctgaccaaggagaccatgggcatttgagccacttcctcatgtaacttacttgtgccttcaggacttcctcaagcccagtcatacttacatcacttccatttgatgatggaatgctgctgtgcatgacccactttatggcttgatgggtcagaaagcaccctggatggctagggacttcaaagaagcatgattggaaaattggtgacaaagaaatttggggaagaggtatgtggatggacttctctcagtggtcaaaaactgtgaagatatttgtatcccctgtgagtgctcaccaatgggtgacctcagcagaggaggattttaataatcaagtggatgcgatgacccgttctgtggacaccactcagcctctttccccagccacatgtcatcgcccaatgggcccatgaacaaagtggccatggtggcagggatggaggttacgcatgggctcagcaacatggacttccattcaccaaggctgacttggctacagccactgctgagtgcccaatttgccagcagcagagaccaacactgagccctcaatacggcaccattcctcggggtgatcagccagctacctagtgactagttgattataatggaccttttccatcatggaagatggcatcatggcagaaatttatcctcactggaatagacacttactctggatataggtttgcctatcctgcatgcaatgcttctgccaagactaccagccgtggactcgcggaatgccttatccactgtcatggtattccaaacagtattgcctctgaccaaggcacgcactttatgactaaagaagtctgacactgggctcatgctcatggaattcactggtcttaccatgttctccatcatcctgaagcagctggattgatagaacagtggagtggccttttgaagtcacaattacaacactaactaggtgacaatactttgtagggctggggcaaagttctccaaaaggctgtgtatgctctcagtcagcctccaatatatgttactgtttctcccacagccaggattcacgggtccaggaactaagaggtggaagtggaagtggcactactcaccatcacccctaatgatccactggcaaaatttttgcttcctgttcccacaacattatgttctgctggcctagaggtcttagttccaaagggaggaacgcggctaccaggagacacaacaatgattccattaaacttgaagttaagattgcctggacactttgggctcttattaccttaagtcaacagggtaagaagggagttacagtgttggctggggtgattgacccagactctctagatgaaatcagtctacaactccacaacagagataaggaagagtatgcatggaatacaggagatccattagggtgtctcttagtcttaccattgcctgtgattaaggtcgacgggaaactacaacagcccaacccaggcaggactacaaatggctcagacccctcaagaatgaagcagggaaaaaaccacaacctgctgaggtgcttgctgaaggcaaagggaatacagattgggtagaagaaggtagtcatcaataccagctacgaccatgtgaccagttccggctccagaaatggggactgtaattgtcatgagtatttcctctttcttttgctaaaaacatgtttgtgcatgtatacacttgtactaagaaaatatctttattgtatttccttttcctttattgtgtgacataagatttactgacttcatatcagcatttaagtattgctaatcttatgtaatagtatttgggttggggatcagtgcgtttctggtagtacaaaggatagttgtattatgttaggtgtaattatgatcttattgtatttgaagattatgtatgatctcaggaaatgtgtatgggttcaagttgacaagggatggacttgtggtggttaataatgagtgtcgacttgattggattgaaggatgcaatattgatcctgggtgcatctgtgagggtgttgtcaaaggagattaacatttgagtcagtgggctggagaaggcagatccacccttaatctggtgggcaccatctaatcagccatcaacaaatataaagcaggcagaaaaacatgaagcgagagactggcctcacctcccagcctacatctttctcccatgctggacgcttcctgccctcgaacatcggactccaagttcttcagttttgaggctcggacctagctcttcttgctcctcaagcttgcagacagcctactgtgggaccttgtaattgtgtaagttaatacttaataaactctctctctatatatatacacatacatatgcatacatatacatatacatgcatatatatacatatatacatatacatgcatatatatacatacatacatatatatacatatatacatatatatacatatatacacatatatacacacatatatatacatatatatatatgttcacgactgcaagtggtcagatgctggctgctataccctgcctggacccagatgccacagcaatgtcaccttaatgaaaactatatgggggaaaatgacaacatctaagtgacaacacttcacccaccaatagcaacgcccttctcacacccaccacccaacgactgatactcatgccaaatctttcttgaaattactattccccaccatcctttacagactgcacttaagaaggaaggagcccacagaaccgaatatcaatcacagaagctgcatagccagacattcagtgttcgatgtaccgaaaaatcctctttacacgtctttatgcttctggccactacagccgcaaagtccagccattagaagggacagccatctttcagagtcatgtcccttgatgaaatgtcaatgccaaagaaatatagacagatatgccttatgtattttgccatgtctcctccctcttgccatcacagtctcctctaaaagagtaagcaactaaaaaagaaaagctaaatgttcagtccctgtaaaacaccatttacaataacaaactcacactgatagaaaagggaagatactgtattaatagcacatcaggtcaaaaaattagaacataagaatgataaaaaccatggcaattaattcaacgccctatatatagtctatcctgtaaatataatttgatttgcacagagctcctcagctggctattagtacagcgatcagctcaggtcttctaggccagtccttgctttgcagcacgatgccttgtaagaacaattcagtggctacaaaaccttggaaatagtacttaactcctttgggtcatccaagcaaaactactctcgtgaagctcatttcattgggatattggggaaagaaatagcagagaagggatggaggcacataagaaacaatcattaagaagacccaggcaagaaacaaaacaattcttgagcattttaagtaaagaaaaaggcagcatgttacagtcactaattaacacatagccctttctgaggagagattctatcacaggctccaggccagatactaaagcaaaagaatgtgtgaaaccaaactcctacctcattaaagatctctggtctgagttggccctacatgttattatatgccattatcttcatcttcattacaatgctgagttgtgacaccttctatgttgacagagctcctaaggatacagaaggagagtcgcacatcttgctctgtatcttaggggactgtctgctatccaagtgtacttgcgggtgtctatttggaagattattgaagtaaatgccaaaatacaaacggtgcattgtttgggtgcagaaaaaaacatatagcaaaaaagtaaacctgtgggatgtgttcaaggcaccatacagcaaaggcaatccatttccttgtgctaccctcaaaatgttatacaataatttctggtaaaaactctaaattaaaacaatttaaaagcacagcacctctaatcctgtttaagcctgaaatgatttataaatacctacccaggaactactctgccaccaaaggaatgcagatggcctcagtgaggattaatccatctctggaaggttcttgaggactaacttatcctttcttattttctccagagtctagcaaggttccacctctataacagaaaccccatgaatatgggactgctgttaattcacgctgtgcttttagttcttttcaaagcttacagatattcatatttttccctcattttcttttctctataaaagtcccataagagaaagagacacatgcacaaatcttgcactacagatgaggaaacaggcaccaaaggttcatgatttaccaggggccacccaggagcaataggccagcaccccagggcccatcagcttagggctttcctagattaaatgctttacacacatttcaggtagaccaggggaggctggctcttgtggactatgtgtacctaaattgcttaagagtcataaatgtggtccaagattttcaaaaagtcataaccagcacatgaactaacagaccaaagactcagcctaggtggggtcaaactaaagctgcagaggaaacattcctcctttctggttctgtgtccctaatggatgagggctccagtgacttggagggaagagtgctggtgctccccagggcctctcaacccgggtgcgcagccatctggacagagtcaagctctgacaaacccaacagccgccagggggtgtagctctctactccccccaggaggagaaggtgggggttctgcagctgtgtgctgacttgagcttcttcctcccccctctccccttcaggctcccctctgacccaacaccccatgggcttggcctcgctaaggctgggaaagggctgcatttgtttctatctctgatcacatttggaatccctggcaaagtgaaaacaaaccttccattcttcagccgtgtttgttttgggcccatttggcaccacccttcccatttcaggcttattttttttccacttatcgtcatcatgaatttggtagaggtgagtcattggttttaaccctggctccagcttcctctcgtttgtacttttccagtctaatttcctttatttgcagcgccttgaaagtctccaatcgctagcctctgacatggttatgccgggtcctgagctcgggctgtctccagtcctgaggcgtgtgggctcctgcacgctgggccaggggtttctgagtggttgttgtgttcctggttctgaggctcctgcccacaagatccgaagactcaccagggcagctgctgaccttcaggtggaggcagggagcctctgcagaagccggtgccgctgcagagctgctccaacactgccgtggtgtcttataaagccacaaagcttgagttgacaattggggtagaaggaaaatcactgaaactcctctgtcttaaatgagcttgatggaaagcagtccctaataatacaatcctagtgctgaaaagatgtctctcaacttaaacatttgaagtaggattttaggctttcttctcaataatttccccacaactctttgggaaaaggtgactagttaacagagcagaaacggtgggcaggagactggaagtctttggagtcacacatttggattcacatcttatttgtcagttactttggtaatgaccttaggcatgccattagtctttctcagtagatatacctgaccacaaaagagagtcccaccacttaccttgtaggatgtgaagactaataagactaagtatgtaaagcacctggtctaaaggtagctgtatttgctgttatttggctattagacttcctgaatactgctgaattgcttaagtcatactggggacaatcttctaaacttctcattccccaaggaccgattaagttgagacataatcataaagtcaacaggacacatgacagatgctttcaaaatagattcaagtcccatggaaaaaaatgttcaattctgcctgttggacagttgtcatttatactctcttccgcctcccctctggagtccttataaatatggtggccaattaggaagttatcattactcacccacagtgaaagaataaactgttcatgaaccattttctccctttaacacagtgttcatacatttctgaaatgtgtaggcttcacttgcattgcagagactgggatggtgtgtgtgtctcagataagtgctgctcacagcgtggtggggaacaagcagcaccactaactctgggagctcatgagaaatagtctcaggcccaccccagccctgctgaggcagaatctgcattctgaccagattctcaggtgatctgcaagtgcattcaagtttgggaggctccttggtcacacagaggaggcagaggtgtgacggtgaaggtgccggccccggcccaggaggcggggttctgactgctcttcagcccctgccacttcagcttagctgagggacaacaggcgagtcatatcaccctccaagcttaccctcgttacatccaaaattgtgaagggcctgaggttttatgtcacttgtcagctaatacgtcagcctgccactgtgtgtgcatgtgtgtggaaaagtgtgtgtgtgtgtgagtatgagtgttcacaacagaaggtgcaagacctctgagtcagagagagcagaaagaacgacatcttagcactagtttgctaagtgccagtccccacagtgatgtgacatggtgagggccaagtgtcacttatgcatgtagtggaatcatcacagaagagaagccccagaattagggaacgctgaccttgtacagggctgctggtgaccttccctctccactgtcgagagggagagacagagacttagcttgatcctggaatgtaagcaactgttttagggaagtggaagggaaacttctgtaagctgtattgtcctaaaatgtctccttatacgaacattattaacttggctgtaaatgtctttgctcagaggacctggactgtgcagaaacatgacatgtccataggaactgtctctcaatgtgcccatgtgtcaggagaatgggtggctggcacacagcaggcaacagtacctggccactgccccgggggagcttgtagtctgagaaccacccacaatggaaccacagtgtcatgagaggggaagtcccaggtgcctgtgggaacgcacaggggtcagcacaccctgatgaaggcagggctgtcaggaaagggttcctggggctggcttccaagctgagacttgacgtttggattggctggttctgagtgccaggcaggaagccctgacagtcggccgtgagagggtggtggggatggggcctgctgccttgctcctgatgctcaagggcccgacttcattctgagggtttagatgggggggactggggagagggagaaatacatgttgattccctggttctggcttggacaactcaatatccaagttatgagagcctagtaacaagatggaaaggggagcagagtttgagggacgaaaatggtgtgctgtatgtaggcaatctgctatgtttctgggagtataaattgagatatccaatctatgcagtcatcccttggcatccatgggagagtggttccagcacccctgtggataccacaatcccacagatgctcacatccctgatataaaatagtgtagtatgtgcatataaccttcacacatcctcccatatactttaaatcatctccagttacttacaattcctgatacgatgtaaatgctatgtaaatagctgttatcctgtattgtttggggaacagtgacaagaaaaaaaagtctgtacctgttcagtacagatgcaatcatccatttttttcctgaatattttcagttcacagttgggtgactctgccgtgggttgaacccttggatgcagaacccacagatacagaaggctgactgtctatgattaacaggcaaagaaaagaacatgaaggcggttgtaacttacttttttttcctggatatcagaaagtgaaatgctatttttttgtatttatttactaatatttgtttacaaatatttattcttttgagaattatttgttcatcttcttttgaattcactgggaatttgatgtgtttatgactgatttatatgaacttcccattcattttcagtctgtattaggttttcagctatcactgctactttttagaaaccttaagtgtggagttacttaaaatcctgggggaaagatttagactgagcccaaaggataggccaaaaagacaaaaaagaagacctctgatggaccaagactatgttcttttgccctattttcagagcttcagggaaattaaatataaacggatgtatggacaagtcaattctgagtttaagaaattaaagcagtgctactaattgataattttactgatttgttaatgttcttgagaaaacttgaccttccagtaagtccaagtaaacagatacaatcaccaaactcctgggttcaaattaatcacacactaggaaaaacatgtcttgccttagatacaactttcgatcacgaccacagcactggacagggggctgaggggctaacccacgaagaaggtctggagagatacccctacgtggcacccttgtgtcaaagtgtgaatgaattggggggagagatgcggagaggaagaggcagggggagagggccagtcagccccatccccagaatcaatgacatcatttattctgcttttttcaaaatgaacattgatgctgttcccccaaccagtacagattcaccatatttccacctatcgaaattctatgtgctcttttaggttcaaagagtatcaactttctcatgttaattaaacagcatgttaattgacaacatccatgttgttaattgtcctagtttttttctcaacccacggaacttatttaatattgcagggtatcaacaacccttttcccacaaagagtgtaggtttcaaaaatgtcaaaacaattccctcatgcccactttccactgaagccaggtatagctgaaagttaaccttagctacagaggtcatgctctgctgttctgtaggtaggaatgttagataaatgcaatgaattcatgctcttataatcaaacaaactttataccccaccaccatctttgaaaataggcacccatatcagaacatgtgtatttctactccatcatcttagcttccctccccttcatttcctacctcccacgatgctcccccaaaaagtaaacagcaattacttctcttaatttagattggccaagattgccctaaatttcattatcactctgaaactgctacaaaggaatgctcaacagatgtcatttataatcttctttattcctgacttagataaattcaaagtgatctagttagaggttttgtcaaattcttggaataccaaagatgtcccctattttccagtgttctttcttcggttgtccctacctagaatgccagagcaactacagccaaccacattctgactagcacaccaaacactcttgatcgtgcctagtttgcaggatccttagcctcaggcttgcccatacatcctgaagccatgtccacagagatgctactccagttccccttaacagaaaattcatccttacggcgaccccaagttaacagtgaagcagaagtgctcagacatccaggaactgccagagcctgcctggcgagctccagcatgcacttgtgggcccacgaggaccctgcctgcacagctgtgtcctgggacagctaccctagcatctgtcttcatttcctctttccacatgcattctgcagaaggccttggctaccattaatggtggttacgaaaattcaatcaggctgtcctcacaggcggttttctcaggagataaagacccttcactgccccttgccttctgtgctttctttgcagcattgctaagtctacttgccacagctcatcttcagctgtccatgtgcttatcatctgttgttcccagtggcatggctgccctgtgagaagagggattttgttttgctcactaatgtgtccccactgtgtagagtacctggcacagacgaggcacttacagacatcaggggaataagcaaatgcccacgtgcagcgagtggatgctcagatgtgcgtgccagggaaaacagctaagggctgctgctgaaaaaattatgaggacacgaaaccctgtcctatacaaatctactacaagagtgggggactgagagccccggtgggggggaatctttctctactgagagccctggtcgagaagaatttttctctactgagaaccctggttggggcaatctttctgtactgagagaccgggtcggggggaatctttctctattgagagccctggtagggggaatctttctgtactgagagcccgggtcagggggaatctttctgtactgagagcccgggtcggggggaatctttctctattgagagccctggtaggggggaatctttctctactgagagccctggtgggggggaatctttctctattgagagccctagtgagggggaatctttctgtactgagagccctggtggggggaatctttctctactgagagccctggtagggggaatccttctctattgagagccctggtggggggaatccttctctattgagagccctggtgggggggaaatctttctctactgagagccctggtggggggaatctttctctactgagagccctagtgagggggaatctttctctactgagagccctagtgagggggaatctttctgtactgagagccatggtggggggaatctttctctattgagagccctggtgggggggaatctttctgtactgagagccctggtggagggaatctttctctattgagagccctagtgggggggaatctttctggactgagagccctggtggggggaatctttctctactgagagccctagtgagggggaatctttctctactgagagccctagtgagggggaatctttctgtactgagagccctggtggggggaatctttctctattgagagccctagtgggggggaatctttctgtactgagagccctggtggggggaatctttctctattgagagccctggtggggagaatctttctctactgagagccctgcgggtggaggaaagggaggaatctctccatggctttggctggtgccagttttacctcagaccctggacctggattctgatctcttgctaccagctgcattggctttggatcccgagccctgtgtgagggttcctgaacctcactgcccaggctccaggtcctaacatctggctcagcagtgctccctgcacttcattccttttctgtaaagacctgggccacctgctcatccccactactccaggagacctccctagcctggcttctgcccggccacactgcctgtggtgctggtctttgtgcctgacttcccaacctccatgccactgtaaaccacatatctaaggcaatcttagcaatgtctgacttagggataggcaggtcacctgattctggccaatgagtttgctagggggcttctggcgaagctttacttgctcctaaaaagagatgaaagagaagatgcctgtttcttcctctcaatgccacttgtctgggtgtgaagcatggatctactatggccaaccctctgccagcctgtggaggcagctgctctaggaggagggcagagaggtggccctggaaaagccccaggcacccacctctcctgtggtcaaccccatcctgagacttcttcaaggagtcaatgtgtccttgctgcctgggcctgcagcctggctgcatgagatgcctctctccccaaccctgaagagtcctgatgtccctgaggagttcagccatggacctccagaaagtcctgtcaccacagtgagcttccgctttctcagtgatgacaatgtgcaggctgaacctagccatggttcccaattttcatgcctaaggacttcctttttattgaggtaacattcatagaacataaaatccattttaaccaccttaaattatacaatttagtggcttttaatacattcactatgttatgcaacccaccaccaccatctaattccagaactttcatcatcctcaaaagcaatcgatacccattaagctgtcactcaccattcccctttttctcctcagcccctggcaatcagtcatctgctgcctgtgtctatgcatttgcttattctggatatttcatataaatggccttgttgaatatgtggcctggtgtctggtttcttttatgtagcacaatgtttttaaagttcctccatgactgtatcattaatcagcacttcattctttgtatgacttaccatgttttgtttctccactcattggctgatgagcatttgggctgtttcaattttttggctattgtgaataatgatgggatgaacattcatgtacaagtttctgcttgagcacttgttttcagttctcttgagtgtatacctaggaagggaattgccaggtcacatggaaatgctgtttagctttttgagggtccatcaaactgcttaccacagcagcaagggccttgttttttgttttaaaaatatttttattatggttaaaacacttatcacaaaacttaccatcttaaccattttaagtgtacagcttagtagtgttaagtatatttacattgttgagaaacagatctccagatctttgtcatcttgcaaatctgatactctgtacacattaaacactaatccacatttccctttcccccagtccctggtaagcaccattctaactttctatgagtctgactactttagatactgcatatacatagaatcatgcagtacttttcctttggtagctggtttctttcactaggcataatgacctccaggttcccccatgacgtggcatatgacaggatttcccctttttaaggttgaataatattcctgcgtgtgtgtgtgtgtgtgtgtgtgtgtgtgtgtgtgtgtgtgtgtgtgtgtgtataccctacattttgtttctccattcatctgttgatgggcacgtgagttgcttccacctcctggctactgtgaacagtgctgctatgaacacaggagtacagatatctcttggtgaccctgctgctttcaattcttttgggtatatgcccagaagaggacgagggctaatttttaacacaaaaaactttgtggattgctacccaatatatgtttcacttttggtatctagatccttctggatctttagcaaaatctgacatctcacctctcaaggcctccatttaggagcacctggattaagtgatcctcaggttgtgtccaactctaaatctgctgattctatgagaatcccttgggtagaacaccacccttgatactccagcccgtattaattccacagtaatgactacagtcctgccttaggggatatgcactataaaaaatcaaagtaaacacctgccgagagagaagggaaggcccaacagaacatgtgaggataaagaattttcttccccaacatggctactactgcattcaccttttttcaccaactggaaaataagaagtaatcaagttaattgactattttatctttagagaatcaaagtccaagataattattactgattcagcaagtgttttctgagtgctatgccttctgagacaattgaagtcaacagggcttatctagataaaaagtacttaaaaacttcaggcctagtcattttaatgtaataaactcaataagggctcttactttcatgtggttattattacatatttcattctataaaatccaagcactggagagttgatttaaattcagttcatatgtttatgtagtaagaaaacactcctgataaatagtgcaacctttcaagtcacaccataaaaacaaaggagcctccgttccaagaggatgactgcagtgcagacacacagagcagagcctggaagggagaactgatagccccatttcctttcttccctccttccatcagatcaaaacagtcctgccggtgtagataggagtgtggcaatcttagaaggaggctgggacctgtggagggagagagagcaggaaggggccattcggaagctcataaatcacacctggtttccacatccgttatgtagccagagttgtacaaatactgtctcaaagcctattaccagaagccactggccctagaggaaagcctggccgcccgcactttctttcttatccccaaatctaaggagttcagccaggatctcggacatatgggtacccatatgctgtgccgctctgtggcgaggctttgattcactgcctgccagcctcaagcctttctctggcatccacctccaggacaggaggaatcaggctagattcactgggaatcctgacagtgctattaccctgtgttcctagggcgactctgagcaaaactccttaaaatactcacagcgtcatttctactgatcatgctaaaatacacatatccacaggtgttgggagaaatgtttaatttctattatatacaacaacaaaagtggtattgggccatgatgaattaatccatgattaaggcagtcccatgtgcttaagaaggcaattatttagctgggaaaatgagctaaacatgaagatatattctatttacatttattttttatctaaagaaacaaaatgaattaagctttgccactatttactatgtggcccccaggcagactgtccctcaccggcctcctggtcctgagagctcccagggaagccgtggggccgccacccaaaggcctccatgcccttcatctgctttcagtgtcttgcaacatacccatgactccatctggttaacggggtaatgagttcaattctctagtatcatcctcaatatatcccaagtgcctcaaactgtgctcagatgatgaatttagagtgaatttaagctaacttttacaaaatggacaagtagcttaaaaaaaattcctgaaaaaataacctctggaggccgaagttaatctcaatacaagcacaagtgaacataagcaaagggaagcgctcctgcctgtcgtcattggtctccatgttacaaataccaacaacctagtcacatgtgacaagaagcagctctccccaacaaaacctgaaattgcctggaagcccattagaaatttagatttacatcctgaatcattaacgagaaatcccatctcaagggtatctggaccttgagatgagctaatgatagtaccaagtcactagaaatagcaagacatttaaaatactgctgatttcatctttatcaaatatcttaccattcattttgtatatgtttcataacttatatagtggtaatgcagtgcacatgtatacttttaaaatgaatactcatatgctggggatgcatgcagaaaacatttttcttaattgatggagtgtgtgatcaaatttggggccacaccactgtacacagcatgcccttggtcaggaaaatgggctgctgcagtgctcagcctgagcaacagtaaacactggcataggggaagagagaatcatttgccatgtaagcatcatagttaataaattatcgtgctgtcattgctgttggaatgccaacagagccaggtactgccagctgacgcctagtagcacaaggtgctgcttgcttgttgtgggttgaatttacgtttcccccagaaacagaggttgagatcctaggctccagtacttaagggcatgaccttatctacaaacagggttgttgcagatgtaattagttaagaagaggtcatactggagaagggtaggcccctaatgcaataggacaggtgtctttataaaaaggggaagtttggtcacagacaggcacacagggagaacgtcaggcaaaggcagcagagtgaggctgccaccagccaagcactatcagaagctgcgagacaggcctgcgacagaccttccccagcgcctgcagagggagtgtggtcctgccaacaccttgatctcaagcttctggcctccacaactgtgagacgaaacatttctgtttttaaaccacccagtttgtgcaactgtgttatgggagcactaggaaaactaatgtgctgcttcttggtggagaggcagccagcctgcctggaagttctgcccactctaacctgggtggagatgagaatggctttgtcctaatggcagatctcgaagctgccattaggacagcctgcagcctctggagaggctgccagacgccaaccctccctgggcagcctcgcttgcacagatgtcatcctgcatggggcttcacacgcagcggatgctgccagcagactcggctgccgtcagggggtttgagggcttgtgcttgttctgtcaactttctgccgcccaagttgccacaggcaaaacgcttccttttaccactcccttgctggcacataaacggtgacacttcagcaatgccccattttgcctacaaacttggtctctgagtctcagtctgacaaacctgacaggaagaactgcccaacagcaacgggaatcttcctgattctccttcccagggcagatgggctatttgttactattttatgctgccatgaaatcaggcctgctttttattctgagggtcttgctgtaccttccttacagcttctccctggaagaggcctctcagtccataagcagtgacaaccagttaccccctcaaacagacactacatgtcactcagtgcctgggccatgttgcggctctgcctttggccagtgcagggctctgtggcccgtggcactccagcacctgggtcagctgctgctggcaagtggtgggccctgtctgccagcacagggcactcacaatattggagctgagccaggtacggtggctcacgcctgtaatcccaacactttgggaggctgaggcaggcgatcacctgaggtcaggagtttgagagcagcctggccaacatagtgatatcctgtctctactaaaaatacaataattagctgggcatggtggcatgtagcctgtaatcccagctactcgggaggctgaggcaggagaatcacttgaacctgggaggtagagcttgcagtgagctgagatcacgccactgcactccagcctgggcgacagagcaagactctgtctcaaaaaaaaaacaaaaacaaaaacaaaacaacaacaacaacaaaaaaaactggagctgagagctggccggtgctcagcatccctggtctactgaaatctccacacacatggtagagaacagggacacgcccctcttaaaaggcagctggcaactagcctggatataaaaggtgacattagaacttaagggtaatgttgaaattggttcaccaaacggcttaaagttcaaacatgcagatcatggctaaagataaaaattcccaggcatacatgcctgagatttaagctggcacattgctgggccatcttttaactgaagttttaaattttctatttattatcttaacaatgaacttgactgagagaaccattaaaaattgctatagatcaccatttggcatctgctacgggttgacttgtgtcctccaaaaaaggcatgctgaaatcctaactcccagtacttcagaatgtgagcttatttggaagtgggatctttattaatccagttaaaatgaagtcatcaggatgggtcctaatccaatatgaccagtgtccttatgaaaaggggaaatttggacacaaagacacacaaagaggaaagatgatgtagagacacagggagaaaccatgtaaaggcacaggactggagtgatgcatctacaagccaggggatgccagagattgcagaaaccaccagaagctaggggagcagcatggaacacatgcttcccacagctctcagaagcaaccaacctgccaacaccttgctttcagcattctggcctccagaactgagatgacaaatgtgttatttaaagccacccaggttgtggcattttgttaaggcagccctgggaaacaaatacagtatatctgcagtagttactgtttcaggcaagcatcatcagtgaatgctgaaagtagcaggcaaaagtttgatgagaaacacaatactcatagagttgcaaagtattcccccatgagatatgtatgaattacaaagggtaaaatagtaaattgatagtggagaaacttggcagatgccatcttaactgaacaatcaaagctggcatcaccggccatgagatggggagtgtcgtgtacctcctgatccaatgcatcaagaaggacaagacctcgcttctgtgcagcccctgccctgaaagcaggacctgaatccaatcatgaaggcacatcagaaaaattgaactgaggaaaatcctacaaaataaatgacctatactcttcaaacatgtcaaggtcatgaaagattttaaaaagctggataactgttctagattaaaggcgactaaagatatatcactaaatgaaggtataatcctggactgaaatttgtggcagtagtgggaaaatgggccaagtctgaagagtctgtagattagataacactactgtttcaatgttagtttcctgattttgataattatacagtacttgcttttagtaaacacacactaaagcattccagagtaaaagagctcttcagaagaaagttcgtataaacagacagatgtagatttagatatatgtgagcgttaagaaatgggaggagcagggctgggtgcagtggctcatgcctgtaatcccagcactttgggaggctgaggagggtggatcacaaggtcaggagatcgagaccatcctggctaacacgctgaaactctgtcactactaaaaatacaaaaaattagccgaacgtggtggcatgtgcctgtagtcccagctgctggggaggctgaggcaggagaatggcgtgaacctgggaggtggagcttgcagagagccgagatcgcactactgcattccagcctgggtgacagagcaagactctgaatcaaaaaaaaaaaaaaaaaaaaaaaaagaaagaaagaaatgggaggagcagcaagtgtggtgaaattttaccatatgaggaatatggtgaggggtagatgggatttttttagtactttttttttttggcaatttttctgtatgtctgaaattatttcaaaacaaaaagttttaaaaaatcaccacagatgtaataacagctatcacttaatacgtgactgagatggttgaggtgtttttatatgttgtctaattgaccagtgaattataatcacatgaggcaaatattatgattcccactggcactctaggcctcacccaggaccaagaagaggtccatcttggttggaaagggatgagggaactgaaaggctctcgcccacaaggctcagcacacacacagagcctgctgaagtccaatggcagggcaggaaaatagacacaccttccaggcattcatatcctaagccactacaagtgggaaggttataatcctaccttcaattaatttgatatttgtgaggtcttgaatctaacttaagcagcaatacagcccaggcccggttcaactataaatactaaattaactcacacacacacacacacacacacacacacacacgaatgggtttgaacagaaaaggcatgctgttttctggactgatgtaaatattatttacttcagcttctagtgttatttctgtctctgtcattcttttacacaccaggttttactttacttaaaaattaaaagaccctcgaagaagtgatgtgacccactgtaaagaaacaaacagttaacagaatgagggaccaagcctggatgttggactcatcagatgaagatttaaaataactgtgataaatatctgtgaaaagacaggaaatttcagcagagaaatggaagctatacatttttaaaagccaaatggaagtggaaatgaaaaacaggatatcaaagatgaattctttcactggacttattgccacactgggcacaagagaaaggagtcaggttcaaaagaaaccatctacactgaaataggagaggaaaaaagagtcggcggcagagaggagaaaaacagagcatccgaggcctgtgaacatatcaaatgttcactatgggtacaactagagtctcaaaaaaagaagagaaaaatgaagcaaggatatttttgaaaagacaatggccaacaatttttccaagctgatgacaccaaaccatagataaaaaatgctcagtgaatcccaagtaagatacatacaaagacaaccaaacttggtgcatcacaaacacactgttgaaaaacagaaataaagagaaaatcttgaaagtaaccataggtaaacagaaacattacatacagagaaaaatgacaagaattatggctgacttctcgctgtacacaatggaagccagaaaaaaatggaatgccgtgtttaacacattgaaagaaaaaatttttaactaggaattcaatatatagtgaaaacatctttcaaaagtaaaagcaaaacaaagacattttcagaaagacaaaacctggaagaattcatctccagcagacatttactatcacaaatattttcagaaagagaataaaacagacagaaacccagtgggaagaaataaaggacaccagacagaatgaacattagatgtgcataatgaatctttaaaagatatttcatatctatctttctttaaacatctttaaaaggctactattaaaaacaataacaatgtaagtggaagttgtagccagtggtgtgttggagctgacttacactggcatgtagagctgactgttcacatgtcttcacaagtctatgtttagtgatgtcatgttgttagtttaaaattggctgtagctgggtgtggtggttcacgcctgtaatcccagcactatgggaggctgaggtaggaggattgcttgagctcaagagtttgagaccagcctgggcaatgtggtgagacctggtctctacaaaaaaaatttaaaaatttgctgagcgtggtggtgtacacctctagtcctagctacttgcgaggcagaggtgggaggactgcttgagcccaggaggctgaggctgcagtaagccaggattatgctactgcaatccagcctgggtggcagagtgagaccctgtctcaaaaaaaagcaggtgcggtggggggctgtggtaggagtattcacaccataaaattagcaaatgctacaaatcgggcttttaaaattttttcttggagggccaggagataagtaatcaccagcacattattttttatagtattggtagaagtaaagtatatgacaaaacacaaagtgggtagagtggtaattagaagtatactgttgtaagtttcttaagttgtttatgaagtagtagactagtttctgaaggcagactaagttaaaatgagggttggcaaagcttttctataaagggcgagataataagttcagtccatcattactatttatttattccatttttgtaaacgtgcctacttgctaaaatttatttgtaaccccaaaatcaaacacacgtagcaccttcgtggtcattcacagacacaggcagagcagcgaaggctttttgtagtattttttgtgacaatcaacctgcattttcccagctgaggctgaaggtggtgctctgccttcttcccgttttcatactgtacacaatgtgcttctcatggcttccacggtaaagacactcttttcattttgttttgtaattaatagatatattggggaagatactttgagactacgcaaatatcctgttgactacgtaaatatcgtgtttttcctcaaacttttacccattaattctgacatccatcagtggatcttgtctataacaattactgtgctgtttgcctcctggtgatattctagttacctcctttcttatacattaagtaactggagttcttctacaaaaaagagctatccgttctcctggcttgttaattcaattatttatgtcagtatggactcatggatatttattttaccgtatgggttaaaatctaacactatcggccgggtgcggtggctcatgcctgtaatcccagcactttggcaggctaagacgggccaatcacaaggtcaggagttcaagaccagcctagccaacatggtgaaaccccgtctctactaaaaaaattagccagacgtggtggcaggtgcctgtaatcccagctactcgggaggctgaggcaggagaatcacttgaaaccggaagacagaggttgcagtgagctgagatcataccactgcactccagcatgggcaacaagagtgaaactccatctcaaaaacaaaaacaaaaaaatctaatactatcactttgttgcaaattattccagctaaggccataaggagattcttcaggtgggcttctataacattctgccctgccccaaacctttctggagaacttccttatgttctggcactacagtatattccaggctcatctagtatttttcctgtcctggcctggaatcaactacttctccaaggaaccgtggttcctctgactggggaatggtgtttagacaccacagtctgggccctagggatgcttatggctgcatgggcgtcagttctttaggccctctcagtgaacaaagctaggaaatacaggtatgacactaaccctctcatccatattcatttctgtatatctgtataggtatgtttgtatctaccatccatccatccatccatccatccatctatccattcagaaccatatgttcatacagatacttctagttcccatccaacagcaccaagttcatttcagtcttctccctttcctatttgtaacctctttctctgacagtgaggaactcggctctttgtttgttgaatcctagtattcacataaggcaatttcagaattgctaaaccatgccccttaagaagcctgtttactaactgaagtacaccatttatgcatagttttttattgtctttagccttatagtatccacttaaaaatgttgttttccaaagttaattaggtaactccctactcccttaaatatggttatatcaagcaattgcatttcccactcccttcaatccgtcagtgcttgtacgccattctgggtccctcccacctcttggttgatgtgaattgttggcttacttgtcaggtgtgtgaaacagtgccatggttctaggtcagaaccatgcaaaaagtcaagctcagggaagaattgttccttattccccatttctgtttcttccttctttccaccccttttccatccaccacttgtcagtgaccaaacccgttcttttctggtttacccctcctgttatccattcctttttaatatcttgtaccaagcccagatcatggcagaatgtcagcaaatgtttgacattaaactgttttctctagtgaaccctgactcctaaagtccattctatgtctgcagtctctcctttacataatgaaactggctactttatcttatgacactcgacaaaaggcttggaaaccaccagtttccttaattgggtcggctcgagatggaatcaagcagccacgcaggaaagtattagctaataataatgaagactattactcttcctggacatgaagaaccaccagtaactagaactcaggttgacggaaattctttggcagcattttcacattttggctatattttttttaacacagcatctcaaaacaacttggtagcataagaaattacgtttaagtctgtggaaagctacaagattaaagggaataagagttgcataaacaattgcaagaaaaataactagtaaaagttgcagggctttttttttcctgtcaacacagtaacatctttaatcttccacttgtcccttttctctgtaatcagtacttgattttccaattaatggggaaggaagccaccagagatgagtcagtaaatttaaaactagtcttgaatgtctggcaaggaaaagaaagttttgcaaatgtacatctatagctaagaaggaaactggcatttggtgttaggtactcattttcatatctgaacaacactgggatcaaaattaaagaatataaaactttaggatcagggtaatgtggataggaaagtcacatgctataagacatttccaagaggataattaagtgttttatacattctgcaagtaagtaggcttttccatacctgaagtaaaaccagcctagtcccctgaaaccttattgtaaagtgataattagaccacctactgacggtgaggctgcaaaagggtaggattatgggtttgaggagcgcagacaaggttatgggcaaccccagaatcagtaagtttcatttacagagagatcaggattgcaatctatgtggatccagggacttacgtgacatatcaggggcaagggcttccaaaccaagacagactcaaggctgaatcctggccaggccaatgaccgactacatatcattgggttggaaacctccctaagctttgctttcttcgtctctataatggacacagtaataccaacttataggtgcggtgagcactaaattcaacgtgaagcacttagcaggtgcccagcacaaaacaagagcccaatggctaagcaaagcctcgtggagcagcgtaaggaatccagaagctgccaccagcactggaatgctggcactgccacttacccaccgtgtgccctcggaaaagtcacttcactctcagagctcttgaagagggagtagtaattcagaatgggagtaatagccaataataaacagctctgagatagggatgataacaaactgagcagtagcacagatcaaatgaattaatatgaacagagcagttagaacagagccgagctcattgcactctgtaagaatgagtgatgatgatgattgattatgattattcaatcagtccaccagagaaatggggagtgggagtgcatggtggtaaaagtaaactattacacagagtaccaggcctcgtggagtgtgttagaaaaagctgttttggcaacttacatcaatagctaaagagtgtacacaggcttaccccgttctgtaaatgctgtgtcgagttgtttaacccacagcagtaaacagccaagccaaagtcaagaggacaagtgctaacacactcatcaggaatgtatcctagcaatttggctgcagggaacaacaacaacaaaagccttgctcatgtgctttgcaaaccataccctgcagtcggcctgcttcaaaatatctggttctctagagatagagaacaaatctttaaggtaaataagatgctacaatctacagcgctggggtgctcgatctttcctcttcaactgttcatcctctggcatatttatttaaattgatcatcttctagaaaagctgcatgtcaactcatgaaaaaaatcaacagaaagaaaactagtgggctgttctgtccttatttctaaacttgctaataaattactatctctcattgtattgacactgtgttaggtagggaactagctatctgtaccttattccacttaaactcaccaagaaaagcagtgtttcattaactttccaggaactttttttccaggcaaggcgatatctcttgccctctttcttccttggggaaacagatggttatgaagaagggcaatgacaccccaggtttcctagagggaaattactacaggcttacacactcttagcctcgattcccaactcaagaatgctcagaaaatggaaggcttcctcataacttgtacggaggcaaaacttaacctgaagtgacactagtccctaaatttaaaaaaattatctaattcggtttgaacatcacatatagattacaatatactgcctgagaccccactgggggtactatgtggtatatgcaaggttttattctcctagggggtactatgtggtatatgcaaggttttattctcctaaaagcagtaatatcctcctagactcccaaatttctccattctaaaatacgtcgggccgcaagtcctacagatatacaattgtgaacttacaggagagttgctgatgctgttacgttccaaacatagctttgtgaatacagtaagtgagaaaaataattctagcgttttttttttgtttttttttttttgagacaagagttttgttctgttgcccaggctggagtgcagtggcatgatcttggctcaatgcaacctccgcctcctgagttcagggggttctcctgcctcagcctcctgagtagctgggattacaggcacatgccaccacacctgactgatttttgtgtttttagtagagacggggtttccccatgttggccaggctggtctcgcacccctgacctcaagtgatccacccacctcggcctcccaaagtgctgggattactggcgtgagacaccgtgcccggacaattctagcattttctttaaactgccttcttttaaaccagaactgggactgaatctttacactgctaatctcatgatttaaaatggacaataatcactaataatcactcagaaatgtcacccaaaatgctgttcttccctcacgtggccgctccgtaactcatactgtatcaggttttatagacaatactcaatggggaaggccacttagaagcagacaggcagggttaccaagaacatgcaccacttcctcatgtgggtgcctactcttggcaactatccatttggaagcctagcccgctgagcactccatgagaactgggttgaacttcctgctacgttacctagcacggtgcatgatatgggcaagctgatatcctctttggggttctgtttccttgtacataaactggggagaataccacctactattcaggactgctggaatgaaatgaaataaaagcatgggcctaatccacaggaatcaaggttagcttctttccacagcctctttccccttccacaccctctcctcttctgactgagacatcatctggagacaggctgtataagtagagagcttagtgctttcttctacgtggacgagctcccgcagaggtgtgttagtggtgcctgtttgcgtattgcaaagtcgagagaaatggattcctttcaaggtccctgaacccaactggaaatctgaacctttaaggaaaataggtgttgagcaggggaggaggggtctgcaaggagacccctgtgcaggccccaggagggttggcagcagaggtatcatataaggacacccagtcactcataagggcatggccttgtaattctagatctggctgatgatccgagggaggaaatgcttcaaccattctgaaatcagaagttcttgccccagctacacagacagccaggtccacccctgaggttcaactagtgcggcaattctcaagggtctccatgtgatttcagtatggaagcctaagttgcaaactactgcccagaaattgttagtatttgtttctctggaatgacaacagaaacctggagtacaaaagactcacaggtgcaagaatttgcctacttcgtccactctggtggtccagccttgggaagagggtggctggcagctgtgtccaccatcagaaaaccaatgagccacaggaagctgctcctgcttggcttggcttgccctggcttccaggaagggaggcacactggctaaacccaggcacctgggcaggtggaggtaggtctctaactgtgcagacagacggggcaccagcccctgggtgtggggtggggaacagggtgggcgcgtggcaactgctcaggaaagaggacctctaggggctctattttctcccctgactgaaaacaaagccccctcctccctgattaggaagggaaaaatacacagaacagggccccacatagcccaggagttatcagaatcatagaacagagaacaaatgttaatgcttaaccgaatagggtttttggaaaacatgctcaagagtcgctagcatcatcccacctggggctttcccattcctggtcatccttgtctttctcttctttggtgtctcctgtatgtgggtgtttctgcacaattcgcattccaccagctttcactgaaatgaaaacagagagtgtgggattaatgtggaaatggggctgcctgtggatcagggggaccagctggaaaggttctggttgctcagtggccacaagtcagtctggagaatctggcaatgaaaatgattaactagggaaggtcagggttgtcggggtaaattcaaaatgatacagcactcaacataatctcttactacagatccactcagaaactttccaaggctcttgtttttctatctggtcacctttcaagtattttgtcagagcagcagtgtaacgagggcacaaactacacaaagagagtggctgctgctttcagttctccacagtctcaacacaagagctcacctcaaccctcccctgtgaaatttactttctcaaatatcgaagatgtttttgatggggtgatatggtgatgggtgacatgggacagctactgtgccttcacagagcccaggcaagtggcaacaaaacttctactgcagctttgcccaaactgtgctgtgaaaccctaccgctggcagatgttaacttagttttaaaaaacagctttatagatatgtaattcatgtagaatacaattcattcatttaaactgtataattcgatggttttgagtgcattcagaattgtacaaccattgccataatcaattttaggagattttcatcaccccaaacagaaaccccacagccatgaacagttaccctccattccacccctcccagctcctggaagccagtcacctggacttgcttatttcggacatgtgatataagtggaattataaactatgtggcctttggtgactggctccttgcacttagcgtgttttcaaggttcatccatgttacagcacgtgtaagtatctcattcctcttcttgtcaaatattctattgcatggatgtatcacattgtatctctccactcatcaattagacatttgcgttgtttctacttttttggctattatgaacaatgcagctgtgaagaacttacacgtaagtttttgtatggacatatgttttcatttccttgagtatataccgagaaatggaactgccaggccacatggtgcctctgaatttatccttctgaaaaccaccaagctgtcttccaaagcctccacactatttcacattcccaccagtgtgtgggttccaattctccacatgttcccgacacttactattgtgtgtctttttaattatagccatcctagtgggtgtgaagtggtctcttattgtggtttgatgtgcaattcctttatggctaatatgttaatactgtgttgtaaggggtcgggtaatctagcatctattaagagtgggaaatgccaggttgaacaaaattaaataggtttccccaagagagaccttcttggcccttagtgtgctacctgcatgaggaagacttacaggaggcatacagcttgccagctctccccagcctatctgaccacacaactttttttttttttttttttttggctataataccagttatcctccatcagggctacagtgttccatgaacagaatttggaaatgctggctggccctaaatccaaaaagccagcctcgcatggtagccaccagcatgtgtttggggtcggcacgttcctccacgccctcagctatgtggtctcagactagtgtctcagattctcaaagattccctgcttcatctgcagaaaggagataaacctcctcagactattaagaagagagaggcgttcgggagagtggggtgctggctagaaagcagggtcattttccttgtagtcattggccccccaggctctggatgtgggccttactgagctttacccttcaagtctctgagtctctgccacaagacggctaacatcacgatacagtcaacttgccacaccatgtcctctggcattttaaactgagtggaccctgccgagtcacgaaaacccaggccaactttctttatgctgctgatgaacgggaaggagaatgggagaggcagcctggggcttacatgcttcaggtgtactggtcttcaatttccctgggagacttggccagcccgactggagggagatggtgacgtttgctcccaggaccagcactgccccagcagctggctgttagaaaagggcaaaagagagcaaggaaaatgacgactatttcctctggcttgggtttagaactaaaatctccctgctgcccgcacctcttctcaacggagaggacattctacttggggcagaaggaaacagaatcctgttcagtaatcctctcaaaaatctgctctatatcccatcaattgatttttaatcactctatttttcattcctacagcttttgtctcaaattcaccaggtatttgatggggtcttattcttttcttgtgcgttcaattcctttatatatttaatcattttagttgtatatccaattatttgattttctgaagtcctctggagtctaatcctgctgtctgtttttgcctgtggattcttgctcttgtcctgggagacttggaggaggaatctgtcttcactgggctttaccagtaaggatctcatggggcctgtgatgcagacagcaaccctctggggagatgctacacgtgtttttgtcaggccaggagtataggtgtctgaaaatccttttcaaggcagatttctcagaagacaaattgccaaacagtacaaatacgaactgaactcatgtaaaagcaagcctttgtttacaaattctcaaggagacctctgtccccatgtggagcccagcctgacacagtccggcttcctggccctcctagggccactgggcaggtttccctcttccacctttccccaggggtgtggcctctgagcatccaaccttggctactccctgcctcctgtgggcccacctctcatgctaaaggtctgaatttcagttccttcttcgttttgggtttccaggaattcctttcacttcaaggtcaaattcttttaaaaaagcaaaaagccaaagacaaaacagaaaagacctaccatttgcaggcagctttttaatctaagattaaaaagatttcccagcctacgtagttggcctcccaatcagaaatggagactgaaaatacaattatctacctacaccttagggtcattttccactctcttgaaacacaggatctcagagttatgaatgtttcgggctcaaggaagagcttagaagaactgtcccactaaatattttttaaaaattcatttccctccctgctctatcccacctctttcccatgctcatcagaaattgatgaaagatgctattacgggctgaatagtgtccccccaaaattcataggttgaagtcctaactgacatacccttaaattgtaattgtatttggagagagggtcttaaaagacaattaagttaaaatgaggaattgaggtagggctctaatataatagaaatggtgtctctataagagaaagagacaccgggtcgtgcacacacaaagaaatggcctgcaaggaaacagcaagaaagtgccatctgcaagcccaggagagaggtctcaggagaaagcagagctgccaacaccttgatcttggacttcagcctcccaagctgggagaaataaatgtctatggtttaagccacccagtctgtggtattttgttaaggcaggccaaaccaacaatacagatgcccatttaaaaatgatctctgaatctttccaacttggcacacataaaacttttaaactgtaactcacagatgtgttcataaagtaaaaataaaaagagctgtgcaactaactataaagaaaactaatgatgaatgttaaggtgacatttgaaatgatcaagtcttctgaagctcctgcagggcagcctgtccgctcctctgctgaaataagcacacagtgtcaaggctcagtcacccagcattagcacttgcatttaatttagtttctaaaaacaattaacttcattaatccctctcagttatgtttggtgattaatgtagcaataaaaagtggcaataataacaataataactcaaagctgagacagattcattttaacttacaatactgccaaaaaatatgacagcacatatttattgtgattgttgtatcactgtctctagaactcttcatttgtaaaactacaaaagaagaattacttttgcagaaatctttgcagaattatttgcaaatcagtatttttaggagaaacagaaaaaccttagatttttgtcgtggtggttgttattcaaatgagagcttcaaatgtaaaaaataagcttcctcttagcagaagtgctgtgcagaggataagaacacagatgctggagccagaaccttgggatcaaatcccagttctgcctgtgtgtgtgtgtgtgtgcatgtgcctgtgcataagtgtgtgcacatgtgtgcatacgtatgtgcttgtgtgtgtggctgtgtgtgggcaagttgctgaagctctctgtgcctcagggtctgccacctatgaagaaagagtgaaaatgttcccctctcccagggccagctgaggattacatgagttaggacacatgaaatgcctccaacaggacctggcacacaggatgtgctcaactgttagctagtcttattaaatgggtttttaagttagcatttagtactcaagagaggcctctggagtcctcaaatcgttggtgcttttccagctcttcaccctctcttcacagcagttccttaaagagcgctgccctacgggttgctggggaatgaaggccatgccctgtaaagcacctgcccatcgtggtgctgaccaccaccaggacctccgtcattacatcaccacctgaggaagctttgggagaatcacagatccaacttctgctcctcatcaccactctgtggcaggcaccgctctaaccacttggagtccacgcatctttcactgcacagcagccccacggagtagatcctgaggcagggagaaggggaagccagcggccccaaatcgcacagctggcaagcggcaaactgggttccacccttaatcgtaggtaagcctttccttgatcagattccttccaggaagcagagcaccatggcttctgagagtaactcaaaggaacggcctacagacagggccaggttattacactacctagataagggaaggtgagtttgaaatgaaaagctctccacagagcagctgcctgcccaagtgggaaggggagtggaggaagctttacctacggtcacatctgggaggtaagcaaacaccaaggaggcaaatgactatgtgggaccctgggccaagcatccgtcctcaggtgtcaggatgcctggctgtaagatgcagtcactggtggcttgctatctgctagtgccaaatagcaaactagaaaatgctactgcgggaagaagaaaggggaaatactggaagagttccatgaaccagggagcaatttccagcagggagctaggaagggctgttaactcacacaaatgtcccaaaagcatccactgcaggtactggagtatgactcacaagtatatgctacctttgttcttgcctgagaagagctatggaaatgttattcaaagggaagctcttctacctaaaagaagtgacgaaaggttctgaggactgttccagtggaaggaacaaaacaaaacagaaaacaaccagtgctgcaggttatgattaaaccaaaggatctcaggtagagcaatgtagtggcaggtaagcaaaggggctggtgagattaggtgggtagaacttcccaatgcgaacagggcaagggactatggcctatcttagttaagaaaaatgactccaccaggagagaggagaatcactggcaagtggagactcacatctatggaagcccatgcacctgaaggtgggaaccctaaaaagtggagaggataaaggggtgagaggcggtaagaacgtatgcagagagtgggtactgacagtctggcccaataacagacataagttatagaagaccccaatgagaaccttgcccccagaccaagtggagcccttacaggagctttcaggtgtgcatagataaggtagaagtaatggtttgtgctaaaaaatgagctggagccccagatactttcctgaatttgcactctcgttggcttcatactgctattctgtgctcagaatcatagactgtgaaggtgagaaggctcttaaattacacggagcaaccctgttaaagaatgaagttcagagacatagtgggacccccctgggccaaacactccatcttccacagcagtgtgtgttccatccttgacatagtttctgacccaaaggacaaaatgagtactgactgggccaggatgggcaccttgccggacatctgactgggcccctttcaagctgggaggtacatggagcagctacatgtatatccttgagtgcagggaggctgattcaaaaagtttaggggaaagtaggatcggctgcctggaagtgctttggaaaagctgtcattgggaattggttgaggctaggactagtcaggtgtttgccagtctcactcccagcttccccgtagttggattgggggcatcaaactgggtcctgcccaatagtatggggaaaagtgactttggtgggcagcatcatgtcatcacgtccccccactctggaacctgtgagtgtgctgggctacacggccaggggaaatgagggttgtagatggaattaaggttgctcatcagctgactgtaagctgaggaagaagaagggaaactgctattctgtgcttagaatcatagactgaaggtgaggagattattctggattacccaggtgggcccatgtaatctcaagggtctctgaatgtgaaagagggaggcggaagagtcagggctctgagtgtgtgatgtgaggatgtgactggtcattgctgcctttgaagaagctttccttggcttgtggaggaaggcgccacgagccaaggaaagtgggcagcctctagaagctggaaaaggcaagaaaatgggattctccccgatcctccagaaggaaccagttgccctgtggatactttgattttagcccagtgagacccatcttggacttctcacctctagaactgtaacataataaaactgtgttgtttagaaccactaagtttattgtgatttggtacagcagccataggaaactgatgtgatgatgcataccacttgtgggccacaccatacggaccccagcacggcgacctacacttgtcccctcagcagcagccacacaatgaaaagctagtgttatacagcaaggggtgtctgggcctctgaattgctctttgttaagaagaccccacccaggagagaaataaacctggattagtttggccactgagaatttaggttgtttgttacaacaggaagtaccattctctatacctaatatagtactttatacaaaagtgaacattctctatagaaacaaaaaaaacttctgaagctgggaagggaaaagcagtcacaaaaccaagtaagaatgcacagggcactggccgaaatgaaaaggacactcacaaagacgttagaagtcacagataaccaaaaatggctagggaaggctgggtgcggtggctcatgcctggagtcccaacactttgggaggccaaggtgggcaggtcgcttgagcccaggagtttgagacctgactggacaacatagtaaaaccttgtgtctacacaaaatacacaaattagctggttgtggtggtgcacacctgtagtcccagctactcagcacactgaggcgagaagatctcttgagcccaggaggccaaggttgcagtgagccaagatcacgccactgcactcaagcctgagagagaccctgtctagacaagaacaacaaaaaaaggctagggaagaggtgaaatgccatgggccaccttgacagaaggcttctgaaaaaagatagtaactaaagggtcttgttttccttggcatgttgggaacaagggcagacctcttacctggaccattcaatttctggtcctgactggttgacactgggactatgcttagcaaatctgtgaccacagggttaatagaagacaaattagtcttctgtttctagcaatggataatctgaaagtctttctgcagggagataattcagggagaattacactagacttttgaaaggcatccttaactcatgtctgacgtatcaattagtgtaagagagaactaagttactctgaagttactaaaaaaagtaacatggcttgaaataaatataatcgtgcttatatttccatttaattcactttgagaggggatgtagagtctgcttttcaaagaaaaccacatgtaagattagtaacattcaaagctatcatgtagcagatttatgagaactctactgacacatggttttggctccactgggaaatggaggggaacagggccagcaaaatgtatttaacaaagagattttacacatctcactgccacagactcacaaagactggcagaaatgagtaatagcgaggcttataattaggtcctcttttctgctgtggaatgctatgactgctgttagatgaaacagaaagaatctcgctaattctaactctgctaatctgcatttgcaataactcatcaaacaagcactcaccccatttctctgcaaatattttgtagtcaagagcagtggtaaggtctcaaatcattaaggctggattacttctacagaggactgcagacgacagcacatttgccaggacatgatgcagtgccatccatcacttgtaaataacaatacctgtatttgcacagcacctttctctaacactcttcagaagcctttacaaactgcctcattcgtctcccaccttgggaggaggcacctggccagtgatggagtcgtctgtcgggctgctgaagttccaaaaggcaacagcctttccggccgctcccactaggtcactagctcaggggagttggcaacagacactccaaacaattgggtcaggttttttttttttagacgaaatattcgctcttcttgcccaggctggagtccagtggtgtgatcctggctcaccacaacctctgcctcccaggttcaagcgattttcctgcctcagcctacagagtagctgagattacaggcacccaccagcacacccgactaattttgtatttttggtagagacggggtttcaccatgttggccaggctagtcttgaactcctgagctcaggtgctctccccacctgggtctcccaaagtgctgggattataggcgtgagccacgacacccggctctgggtcaggtttttaaacggcactgtcctcggtatctcaatgttaagatgactggtgatttcatgagttaaacgtgccaagcgcttagaagtgtgtcagcacattgtgacactcaacaaacttcattagtgtttccaccagtctgctgcctgaaccggccaagaggaccacctgcatccctgcgcacagtacagagagctcagagttgaggaaggtgtgggcccggtttgctatgggggcagtgaggggtgagaagaggccctggggaaactctggagtgcttattgagtattttgtgccaccccgggaataaagagatcaagaagacccagccctggaagcaagaagacaggcagagaggcgaaggttagtgcacgaaggaaaacaaggggattgcggggaatgtacaggagatatgggccagacagcaacaaagagaagacacaaaagaacattaagatagtcactgtaagagaattttattatttctgattgagcattgaggcacaagtctgttatccaatttaagcacttaatgaaagcattctcaacatttttaaggcagtgattttgatttatgaactgtgctcttggctatccttgatgattatcctttagtgtagtgggccgccttttttttttttttttaaaaactatctacccttcagagctgcctactctctggcaatgccagactaaacaagaacaccagagcttcctgccagaaaaggttcacacatggtcctctgtaacatctaggaaagcgcatttgaggggtgctgttggcatctgaggggtgctgttggcatttgaggggtgctgttggcatttgaggggtgctgttggcatttgagggatgctgctggcatttgaggggtgctgctattgggcccctcctctaactatggtcttggagacagatgacagatggtgacagccacccgcaagagctcaccccgtaagtctaaaggggttgccctgaagttactagaggagtttacctgggggatgaacagtgctggtaccctgatgctgaagcgggacgtgagactcactgcagcaaacacagccccaccctgtgacttgccccgaggcccaaacctcgaatttcataaaggagaaaaactgagccccagtgaagcgtgaagtgatgtcttcaaacttagaacccaagctcactgctacactagcacaaataagctgcctcttccctcctcaggggtaaataaactacttactctgtaattcacaaagcctagctgtttactctgcaattcaaagaaaaccagagtccagcaaggaatttctcccagggagtgagtatgtacagtttatacctctgaccttaaaaatctccatatgggcactttggaaggctgaggtgggtggatcacctgaagtcaggagttcaagaccagcctggccaacatggcaaaatccggtctctactaaaaatacaaaaatcagccaggtgtggtggcaggcacctgtaaacccagctactcgggaggctgaggcaggagaatctcttgaacctagaaggcggaggttgcagtgagccaagatcgtgccactgcactcccaggtgacagagtgagactctgtttcaaaaaacaaaacaaaaaacttctttatgggtgtgtctctgtatgcaatttaattactgtactttggttctgtatcattccaacagatacgctttaatgtaacccatgtcctggggagtggagggccagagcaggtggctgctgcagttcctggaggcagccctgcccggggtggaaatcaaggcgctcctccccacagtggacagggacccgctgtggtggaatggaagtcagttatccttaaaagaaatcccatcaaaaaaaaaactccctttgaagtactttttttcttaaaaccaatgcaacacaaattcccccaaaaccattttccatcacagtggaatgattttctaaaaccccatgcctcttaagttctctggcatcagttagacatttttctttcccagtgccagttagttttgttgtagagagcctccgtcaccactgaaaaatattgcctactctggactgcaacatatttaaagaacggctcctattcattgtgctggtgcagagaattcccgccctatagcggaggacagcagagaaggataatgggaatcttttttttttttttttttttttttgagatggagtctcgctcgctttgtcgccaaggctggagtgctttggctcaatcttggctcactacaacttctgcctcccgggttcaagccattctcctgcctcggcctcctgaatagctgggattacaggcgcccgccaccatgcccagctaatttttctacttttagtagagatggggtttcaccatgttatccaggctagtcttgaactcctgacctcaagtgatccaccctccttggcctcccaaactgctggggttacaggcatgagccaccgcgcctggccaggaatctttattgtcaagaaaatggcgcaaatgtgccaccaaaagaagccatgtttctcaaagacttctgttcctacaagactgagtttatgacactaaggcgtgctattaagacctaaaagaacctcacgcatccatacattgaagtgacttggcttctgagacccaaggcctttgatcttctcaccagtgtccctccatatgggccgactgccactggaaaggagagtagaaacggaaacagacccgtctggacagaatccaaagtgcaaacaggaactgtgcccagagagaggaggaggtggcagaagcatgaaggctgcttagatccctatgttctaagaaagaccgctctttcctggctttaacttccttggctcagaagtttaggatttgctcaaaatcagaaaaagcaactttgggggaaaaaaaaaatctggatgtggaagaaactggcggtgaaagtcatattgagtgattaatgataaaaattatttccgctccttggttcttgagtcggtatgaaacgctggcagcctctaattaatcatcaccatgatattaacaccactgacttttcattgcttctgctactttctttctagacatctgtatcctctaagtaaatattatccgccaaaactttgttataagttgtgcaactgggttcgcccaaggcaccggagcctgcgcgcaatcgcacaggtacgcggccgcccgcggtcctcaggaagaaacgcttcgccgccgccggcaagcggggccgaagctccggcgggctcctcccgggcctgggcgcccgacctctccgcggcccgcgcccctcgggcgggcatcaaggcccggaacccgtctcagcgctcgccggggccctccccgcggagcccccgcccggcgcccccgggttcgagcccgcccccggcacccgcgcgtggagagagaggaaaagagtcagtaccggcgggcgggtgtccagctttagtctctagtttcccttcgggaggcgaagacatgacgcggcggggcttccgcggggccgaggcggcggcgcggttctcgggccgggcgggcgtgcgcgagtgagctcaggtgtgagcgccggggagcgagcgggcgggagaacgacgcgcgcgcgtggggcgccggggccgcgcgagccgggtgagtgccactgccgttaagggggcgcggccgccgcgcgccgacgtggcgcagccgagcccaccgacggcatgcgcactgacgtcaccgcggcccgcccgccctgctgggccgcgagccaagcatacggtgcgtgcgcagccggccgcgccacgtcggatgctgtggccgggggcgggggcgggggcgggggcgggggcggaggagggaggggagagaaggggtgaagaagtgagagggagaaggaaggagagggaggcggggtccccgactggctgcggggactggagttgcggaaagttaagtagggcccagctgaggatggctcctgcagcgaacgcgctcagccgggctcctggctacgcggcgacggctgggtgactgcgccccacagtgcgggccagggccggggcgtcccggcagggaggcgaccgtcccctgaggccctcagcccctgccgcggcagcgcctaatgaagcgcggaaaggagagcccagatggcagcgacgggggccgagagagcaggaatttgttaaaagacgatgcgaggggagagcctgctttccgagtgagggccagcgctggggagcagagacggtggcttctgtccctgccctcctcgttatgaaccaaaaataaaattctaagccctgcagccaacggatggaccctcccctccgcctgtggccttctaagttatcttgaaaaactagttcaggccttgatgggaagcggaagtcaaacatggcctcacaaacatccgcacggagaccctaagactaatagaggactctgataagaaacatttgcagtgtattcccggcttcatctgcatgataacaccttggtctccacaactccttcatgcaacccggacattcccttctactgagtccaggtctttagatgataactctcaaccagttgccaatcagaaaacctttaaatgtacctatgacccggacgcctccacttcacattttacctcctaaagagccaacctacatcttacgtattgattgatgtctcatgtctccctcaaatgtataaaaccaagatgtttcctggccaccctgggcacatgtcatcagaacctcctgaggttgtgtcaatgcacgtccttaaccttggcaaaataaacttcctaaattgagaccactctcagaaacttttggttttcaccatcatcttcctgttgccgtggctgacccctggctctcgtgccttggatcgtgttcttcccgcctgccccagtgttttgcaactgctgttaacttccgcaatgccttgctggattcgcattcagacaggcctaatctctttagcgaaggaaacaccacccctcgcttggctgtacttttccctttgacaacaaaactgttcagggaggctgagctcctcatctcttgtcactccctccagtccagtttgtctggttttcatcaagttctgctgcactgccctcaaccatgggaggtccttttgtggaagtcacttataacctatgtgctgccagatccaatggtcattttctactttcattctatttgagctcttagcagcacttgatgcagctggccgtccccctcctcctttgctccggaggtgccacatcactgccttaccctccagttctctggccaccctggctgctcactctgtcagcttggcagttcgccctcttctagatttataaacatttgagtatcgcaaggctcagcattggccttcttctctatctagacttcccatagatagtcacatgcagcctgtggacgactatcatgcagatgcttacaggtgccaaatctgcaacctcatttctctatttctgctcctcccctgaactccagactcaccaccaccaccacctgcagacgcttatgggtgccacatctgcaacttaatttctctctttctgcccctccactgaactccaaactcaccaccgccaccttggcttctctatttgttgtctaactcagtgctgcgcaactctgtgcatcagggcacacatggagatgcacatagcatacattggtcttgcattccccactccatacacacatttcaacaccggtaataggataattgttggccaggctgcagtcatgatatgcttgccattgtcttgcattcacatccaaacttccaagtgggtgccagcagtttagaagagaatcctgaaattaatactgggttactctttaaagagatagcacatcactcacgttcttaaaggtttaaggatacctaactgattaatttcatgagtaacttcctttttatgtatgtgcaaaagtgctatatagttaaaaacttatgtcgtatgtcttaagcctaaagaattatttcttggaagtataaaatgaaaattttaagttgaaagagcacattgtggtatcatttaattggtagtgtttttacccttagtggtacctaaaacaaagttgcatgttacgagccacagcatcttagactcaataacaaatgctattggtaaggaaccctggggggtgggggagaaagccttcacaggaaggagcagagctccagaggggccctggtggcccctggactgccctgaggtctgacaggttgtgtctctttgcctgtgacctgttctccaggtttgtactgattgggaaactctggttgtcttacagtaggtagctagtcggcctgagcagggcaggagaggactcttcccccacaacccacaccaccagaaatgttgtgtgaccatcaggtgatggtcaggaagttgttacactgtttctctaaaataataattggttgcagtcagtgccagggaaaggcagtctcccagtagatagaaaaaacctgaaagtggtggtcagcagcttcctggtaagatctctttgccacacatcgagaggcaaaatggcaacgtttgactggtatatgaccttctaggaacatgaggctggtaagggaagattgcctcaagtgagcatgtgtacacttccaataaacacactgcccctgctcactttccaagcgctggcaagtcactgtgcatgtggacagcctaccccaagggaagaatcaggggataagactgatccctgaagaatcaagggatgcaagactccagaagtatgccaatgtataaaaccctaagtcaaaggtcaaaccgtgcacttgatctctaaagttacctgcttggccatcttccaagtgtactttccttttgttccagatctaaagctttttaataaactttcactcctcctttaaagttgcctcagtctctctttctgctttatacccctcagttgaattcttccttctgaagaggcaagaattgaggttgctgcagacctgtacagattcactgccactaacgtattatatttgggtgctacgtgattcaggtacattctgctcctgacagtgtgacagccaagttaattttacatcttcaaagaactcttgatttcccacctatcggcaaatagcttctcctctagaatacaatccaagctactcattacagtgtggaataatctgtctactcaatagcatttctaatgaaggaaatactgttaagaaggtagtgaacttcgcaaaaaaaagacatttatttttcagcttcccttgtagctaggggtagccaagtgacacagttttgaccatggaaatctgctggggtgttttggggaaaatttacattcttaatatggggacaccccttcctcctggtgacatcatttgtaccaccttgaattcagacagaaggccaaaggtagaacaatcatatcgcaactgtgaggcaatcaaaggcatgaaaatcacaagctaaaggtgacagagcaggaaggtcaaaggcatgtgggaatctgagggtccatggaggcgcttcagagctgtggactcctcgtccagacttttttgttgtgtgggaaacaaatttctattaaataaagtccttgtggttggtgtcttcatgggcagccaaatgcaacccctagcacacatggcctaccagaccctgcatgatgggggtcctgcccagttgtgagctcctccctcttggctcctctggccacactggcctttctgaggttcctctagcaggacaagccaattcttccccttgggactttgtgttagccactcccactgagacagccaagcataaaggggtccgcagagaaactctgactacctgcacaccggaagatggggtggagccacagaagttcacgccctttacaggggagaggagcctgacctcttcccgggtggaatctgggattcaatctgtgacgcgggaaaccggctagcaggactcttgctttgctgaaagtccctgtttcctttttttcctttttgcctaataaattccattttccccacccttcaaagtgtctgtgagcctaatctttcgtggttatgtgacaaggacgctctttttagctaggctaacaagaaagtcctacaacaccactgccgagaactgtctcttccagatcctcgcgtagttaacttcttcttattctggaatcagcttttcaaggggcctgctctgtcttactgtctttatagcactctatcctcatctgaaattcctcatttatctgtctgctggcttattgtttttctccactgactagaatgtcagctccatgaggggagaaacctaatccatcttgcccactaggtattcccagcacctaaaaccatggtgggcacagaagaagcattcaacagttattttctccccataattctagaacatagatacatttaatttctcacaactgctacctaaatgaagagtagccaatgatgactaaacagagaatgaaaaatgtatatagcatatagatggcacatggccagtgatcttttctgacatttgctttatcttgtaaatactttgtgtgtgcatatgtgtgtgcacacgtgtgtgcatgcatgcatgggagtgtccagcccctccagccctagatgctgaggataaatgtcaggcatcacccactggtgatatagatgtactatgtagatgttctatgtagatgtacatactcagtagataggatgagaattgttgaatgaataatcttatttgcatctcacaataacagtaggagtaagatgtaccaaggaaaacaaaaacaaacaaacaaaatggagaagagaaggattgttggacttatgtgggatgcaactctggtgagtgtgacctgggacccaggctggattttctaagccccagttccattcccccaagtgagggctgacttctaaacagagttttgggaaccattttcttttcttctctaaataggctgttttctctcttttttttttttttttttaagatggggtctctttagatggggtctcactctgtcacccctgctggagtgcagtggcacgatctcagttcactgcaacctctgcctcccaggctcaggtgtttgtcccaccgcagcctcccaagtagctgggactacaggcccatgccaccacgcccagctaattcttcgtatttctggtagcggcggggatttgccatgttacccaggctggtcttgaattcttgagctcagatgatccacccataaataggctgttttctaatcccaaatggtggtaaattcacttagtgtgaatgctgtaagccctggaaaaagtatttgaagaagaaacggaaaatgcagattctcttctccagatgtgtattttgtgtccgtggctacatcactaaacctttctgagtctcagtgtcctcatctgcaagtcagagatgtgaacactaatgcctctcccaggaaggttgtgagaattaagggctttgactaaacatgattatgcccgtacagctccgtgtcaccccacttaccccctacaggatcctgagacacagggggttctctgcccttttttgatggagaaattggatctgtagctggattttctaagcttggtgcaaggattggtagctagtgtggggagacccaagagaacccagctcttgctatcttatccattgtaaatttaaaagtgttttgtaagccataatatactagagaatgtactgttattactgcaaagggagtttctttttatcagcattcatgaaatatacgaatagtcccagtgtgtattaaaataatcccacataacaatcacttcgatgaatattgctttctttattccaggctggtttctgtttcctgtcttcttgtgctgttgtctgatagatgagaattttgtattcttatttactacttctatggcttgaatgtgtctcccaaaattcatgtgttggaaacttaatccccaatgcaatggtgttgagaagtgggatctttaataagtgactggctcatgagggctctgttctcatgaatggatttatgctgttatcacaggagtgggctcccgataagaggatgaattcagccctccttcctcttctttcacgtgttctcttgcccttccaccctccaccatgggatgacacaccaagaaggccttcaccagatgtgggcccttgaccttggacttcccagcctccagaactgtgagaaataaatatttgttttttataaattacacagtctcaggtattctgttatagtagcataaaatggaccaagacaatgacccaggatttctctgatttctcctccattgttaattttgctcataaggggagagcgtcagtcattcttgactttgctttgtaacatctaggatatttcttattatactatgtagtgtaggctttaaattaattttaatgtaatttttgacatacacacatacacataaaacacttgaagaggatatacatatctcaaaatcaaataaaaatgatagaatatattttacacacacatatacacacatgtgcgtgtgcacacacacacacacacacaagtgagggatctttgggatttcactgggcctcaacttatcactcagtgacagtttcaggcatttttcaaaagtaattcaacagctaataaagagcatggaggtccattttagtcacatatgaggttatactttagttaacagtatttgaagaaaaaaataaccaggctgaaccttggcaaaatattcctcttatctttatttaaaagttagaaaatagaaactgcaaaaaagttgagagtaacacaaccatgaatattgattttctagggaatttcgaatgctttgtaagttatttataaaaaatgtgttttagcagagaaatgggaagtggtaaggaaaattttatgtctagctcttgcattgagtcattatttgaccttgtgcaagctacttatgcattctgtaattacatttccatattggaggccataatacctatcttacttgaagattcaaatagttattcaatattatgtcttagcatttacagccctcgtgctgtactatgtgcctcctagaggtagttttggcaatctcagagttttgatagcattagtgacaccatttttcagaagggctgttttcacaggctttgaagtgaagaaggtctcaaagaagaggctgttggcctgggttattttttcctccaaaggagcatgttgtatcttctcttactggccatatggacgttttgactacattcaagaaagaattaatttttatgaataagttttttaaaaaatacaaaaaaatacactttggaaaacctaaataacagattaatgtccaaaggaaaaagcaagtcaccacttctcaacaatcctaccagcaggtaaagttgaccacttgtaacattctgttgtacgtccctccaggcttccagacaaaaatagacaaggattctttttagctatcttattttgtaaattgtcccttaatttgtgtttgatgtttttctcatagttaaaaacaggagttacaggtttttggaaggaagatcatagtgacctttttttatcacattatgttaatgtgattattaacataatgttattaatatgactaatcactgaagatgtcaacctgatcacctcatgatagaaagcgtttttaagtatggccattttattagatttaagttaatttattggtgagttcagctctataataggactcaatatgaacatgggctaaattctttgtatcacaaccttgaagttccccaagaattgctaagagtctatattaacaagcctatgcctggtcatgagtctggaagatacctctgggctcttgccatctcagctttatttgctctcactattctagggttagagatggcaagtaatttccttaaaaaaatttagagctttttttttcctgctgaaattacttggttttttttttagaccatctttcttctcaacaaatgatttcctataattgattaattattccattcagggtgaagtatctgtgtgtgactttgcaggctagagagggttgtaaataatgacttctgtcggatcctagtcctcagtgtgtttgcagaaaagccagctctgttcttgctcaattttagaaaaggtccgagcttgggaagtacaattgctgttaatccagataagaacaaatcccaaagccatccttcaggtttggagggaccctctggggcaccattcacaagcttttcactgacacaagttaataaaatgcttttggccatggaaaaaataaaagaaaatatacaatttcagtagctcactggagacttacaacatgactattcacggccttaacaaagaaccacagggcatttgggtaaagaaaagctacacttagcattccaggcaaggttgtggcaaaggtataacttgacatgacatcacttagcacaaatattggggaataacatgctgggtctggcttagtttgggtttggcttatttactgttcctctgtcccttaagaatgttgttattctccttttcttttcccttctcttttcatttcagaaggagaaaccaactccaagttcttattggaatatttacagggtactggaggggctcacagtattaaggagaagactccggcagcctctgaaagaaagaaaactagggaagctctggaaacaccaataaacgacctctgtctaggacgctgctggtggatgactcaatgtgatggttcatttcatgtgtcagcttggatgggctatagggtgcaggtattgggtcaaacattattctagatgtatctgtgaagctctattttagatgagatagacactgaaatgggtgaactttgagtaaagaagagcactcgctataatgtgggtgagcctcttccaatcaggtgaagaccttagcagaaaaaaaactgactgtaggcgtcccaatctcatgagccaactccttaaaataaatctctctctgtgtgtgtctctctgtctctctctctctgtctctctctctctctctcacacacacacacacacacacacacacacacacacacaccctgttggttctgtttctctggagcaccctgactgacatgctcagttatgactttcctctctcctggatctccattccagacctgatgcagtgagcatgcaacattcttggacctgaacctactttgattcaggtgctatgctgtacatgaccttcctgggtgtaagctgaagtggagagaacatttacaacttagtgagctaatcaagcagccctgtcaactgacaaccaggatggatgtcctcataccatatcacatttggctatattctgttatctatcataagttactgatcctcctgccacgtttttctgaaatttgatttcaagagatgagggcactcctattatccagtgttttaccccagagcctatctttacccattaggaatgtaaccccttaacctcataccttgtgtaactccaagttgtaaaacacatttaacataattgcatctgctcctaaacctctcccttgtagggaatagtgttcataaattgtgcctattgttaaagacttaagctgcaaaatgacctcgtactaatttagttcatcatcgcagattatatcttacataaattctcttgctaatcagattttcagaactcagttctagtttttctcctttctaacttgcaaactgcacataaacaaaaagcaataatggctttttgtttattattgttggtaagaacacttaatgagacatctaccctcttaacaaacctttgagtaatactgtattgctaactacaggcatgacgctgtgtagcagatctctagaatgtattcatcttgcaaactgtaagatacaccaagagatatgtcttcccctctcccagcctttggcactaccattttactctgtttctatgagtttgactgttgtggcttgctcatgtaagtggggtcttgcagtatttggccgagtagtttcccactgtgcacagatgtcacattttctgtattcatctgtcgatggacacttacattgcttctgttctaatgaattcattacacaacgggaagtcttgctttccacctcctttccccccaactcccacctaccttgctggcctttctgatactaaagtctgcctgtcccatggagccagctctttccatcaacagccctacgctctctgctttgtttgatctcagttccctggtgtttgtttccacttccaactttcacttaggtgtctggagagctgagtggtccttgagggtccaaacagcaaagtacaggagctgagagactgaaaggaagtctgtccttatcatcagcccaagtgtggtggtcatggtagacatctgctgaccctgagcctccctcctggagtctcttttctgttcctacagtcccaacgctgtagtaacggagaggagggaggcatggttggctactaggctctgaaggtaaatctagaaatctcaaggccgggaagggagttgttgatttcatagactttcttttattcaagaaaatatttttgagcaccttccttttgccaggcacctttctagaaagtgaagataaagtttcagctctctcagagcttatactctagtccaatggaggccgacacagtacatggtgatgagtaacagaggtaggcttctggtattctcctctaaaacagactgaaatgctgaatgatgatccagtttctaaagctttccgatattaatataatgtgttgtttctggacagttccttggaacacattttaaaagatgaaagtcaggtgccaaggcattcatgctttatgttatgtgcaggcaagatctttcaggaagcaattttgggtagggagaggctggcttgcgtacactttatccctttcggttattcatgccagagagatggggcaagtcttttgaagacagtccttcattctctctagcaggtgtcagtaaactgtggctaaaggacaagtccagtccactgcctatttttgtaaataatgttctaatggaacacagccacatcactcacttaagtattgtctgtggccgcttttgtgctacaagagcagaattgagtagttgcaacagaggtggcatgggctgtaaagcagaagtattaatttgaccctctagagaaagtgtgtaggccccttctctacaacagtggttttagtgtggtccctggagcagtagcatctgcaccactgagaggttataaagaaatccaagttcttatcctaccatagatctgctaaatctgaaaccctgggctgggccccagcaatccatgttttcataagccctcctggtggttctaacgcatgctaaagtttgagaaccgctgaacatcactaatctatagtttctaggggactattgcctgctaggaagtcagaagcctgcagcagttttgaaatactgatatctccttattcttttacatgattgcttataaactgagtgctgtgtgtcatgatgtattgggtgatgcatttcaagagaagctatgtgtaatggcgctaatgattaagaattgtgcttacagcagaaaggatcattaactgattttataacacttatgaggactaatatttagctcattgatttgtgaacatcgcatcaatgttcctttttaaagttaaatctctttaaattaatttcgatcacagttgaggagaagacgttgactgatggcattgtgttcatgtgctgtgattgtgaacagctcctggtgttttcccaggtggccatgaatgggtctgatttatggattcccctgaaaggcacaagaaaagcatgaatgtcatggtgtccttcttggctggggtcagttgtgatgctgccactggaggctgctgcctcttgcccactgttaccctcctttaaggaagaaaaggctggcaggcagggcacacaccaagtcgagtttcagttttgggatatctgagatgtggtgtaaaggacagaatggaagggcaagccccgggagctgtcagcttgaggcctgaaataacagacttctctacttctgtgagtggattaggaaagagaagactcagtcagacttcttcaaattttcgacttggctgactcttgtttctggacattcagacttaaaacatcttcatgggcaagtgccttcctctaccttaatttcaggtttagtaattattattatgagctttttttttctcatttatattgcctgtatctcctaaatagatgggattttcatggacagcctcatgatttttttttttgccatattatcaactcaaagaaatgtatgatatcactgttccaactgattaggtagacattcatcattagggtgacaaagagaagatttcacatcttaccactctcaccccagtggttcaacaactttttaaatgattgtagatgacaggagaagtcacaggtcaggggtcactacttggatggtgattgccaatacaaccttttaatataatctgcccatatttatgttgaagcgttttatacacgtggtactttaacgctgtgtcagaaataataatgttctagctgtactgtaccattatcgctaattgtaattttattctcaactagagtacctttgagtattgtttactacagggttggtaaacagtagtctgcaaggcaggtctgacctggtgcctgtttgtgtaaagttttattggaacacagtcatgcccatttctttacatattgttcattgctgctttttggctacaatggcggggttgaggagtcgtggcagacacatttggcccccaaagtacaataaattgactctagccctttgcagaaggtttgccatcccctgctctgctgcatcacttcacacaccaacaaaggcagcagctcaaggttaggcatagacatttgtagacacaaaatcagatcacaaatgccttccttcacattttagctcacatgcaggtatcagcaaagaagaggaaacaaagtgctttgtactcagaaagtatttcagataatgaatcactttatgattttccatgatttatttttaactcttacttttccaattatttatttatttatttatttatgaaatggagtctcactgtgtcacccaggctggagtgctgtggtgcgatctcgcctcactgcagcctcctcctcccgggttcatgccattctcctgcctcagcctcccgagtagctgggactgcaggcactcgccatcacgctcgactaattttttgtatttttagtagagacagggtttcaccgtgttagccaggatggtcttgatctcctgacctcatgatccgcctgcctcggcctcccaaagtgctgggattacaggcgtgagccaccgcacctggccaagtattttaaggcttctattcaaaactaaaacgaactgttagaaaaaatgtaatatctgaaatatatcattctgaatatatttttgtaaatatctaatcacaaatggtcattttttaatggaatagtaaaggccagacttgatctaacaccagcaacagtaaacaagtgggagaaaaacaaacatctctccatgaatccaattgcgtgagtgcccttgttcactacagagtgcttttcttgatgatgaaataagaatgtctacctttagaacaattgtcattcagtgggaggtatggagtcagcctggagcacctctaaaaataaaaaaattatgaaattcagaaacttataaaattcaaacatattcccttttcctagcaggcagtaaaatgacagccgtgtgaaactcatgattacagttaagaaaggaatagaacagaggtcccatttgatcactgttggggttagacctattagaagatgcatgctctggaaaaagaagccaatgacgagagcaaaagggccgagcagccagggttgttgctgtttatgtctttgttgacctatccatccataatcatatattttgagcaccagctttgcacgaggcatcaccttagaggtaaaaaagaaaaaaatgaaataaaaataagtcttcctctagccttatcatagttctgcgaggtcttgggtctttggggagaacagagagaccccagccccagtgttcacatcgctttgccaatgcccacacttatgtgggtatctatctgcagctccatcatgccctggaatggctctaagacatgcttctgtgcttcttgctgcagctcctcccagtggccaacagcaatgatctgtcccctgtctaggggctcccatatacccactctccacctgccagcagagcccagtctgcaccctcaggtggagggacaaacacaagatgggcctgagacgggctggctgagcctgaatccagcattctaccttgatgaatctcctactctcttggctttcgattcccccagggtagagcaaggggctgtgttcagagatggatggctcctccagctttaacctgttgagtctgcacagggagccatctcctggttgcaaccaagtcagggcatggagtggagcaagagttagaggccccacagcaggagtggactccacaccaagatcctcagcttagcctgggaagtttggatttctttggttacgtttaagacacaaaactgattgaagagagattcacaatagagattatggaaactagcaaataaacggaaacattgcttccggcccgtgagtggcaggttagagatttagctgggaacctggaactttgtcttccaattctgcttctgccacttgctggctgtaagatttggggcaagttacttcacctattcatacctcagtttcttcaagagtgaaatgggaatatgaggggcctgcctcagtgggcccttgtttaaagaagctattatgtttaaagactatagaacaacacaggcaaactgtgagcacatgttaggctggtgcagcacagcctcagggaacagagagaaggccagggctctggccctcatctctaaccctgagtggtgactcaggctgctgccccaatggcctaaacagtagctgcagaggcctgacaaaacccaaaagctatacaaaggctcaggtcttggagatcagtctaggttttcactggtgagaaggaagaggcccttcagaagatcctagagaagcccccaggctctgacatccacggccagtccacaaactctctaccactgctaggcaaacaggcagcaacggctctccctccttcctcattcccaccagcctcccagtccaggcgtctttttctctttaaaggttcccagatgtgaatttgaaaggtaaggaaggagaggcagacaagagaagggaaaagatgtggttggagttgcccctgatactcacattcttctagaaagaacattcctcagcctcccactgtatgcaaggctctgagcagctgatcgtccagactagtgaaggcccagctctgttctgatgggctgagatggaagagaaagatgtgttaggcagaaagagaaaatatgtgtgtggcagaggacagaggctgcttcagacaactgcttgcaggagctacagggcatgtacgcacacacatgcacacatgtaggtgtacatgcacatatataggtacacacatgcacacacatgggcacacataggtgtacacctgcacacatgcatgcacacagtcacatgcatgaatgcacacataaacacaggcacacacacacaggccttccgcatacataaatacacacacaggtatacacacactcaggcagagctactttcagctgcatgatggtaggcagaggcagtgacagtaggaatgtccagcttacttatctgctggtgaagacccagatcaatttcccaggtggtgactttctgtccaacattagtcccctgtcttctagggttttaggcattgagaaattgacagccatgggccctggaggtctgtaattgtttagcaatcagctctctgggggtcagggatatgggggagagccctgatttgtagagtttgcccatttctgtggtgtaaacactccactcataaatgatttcaggctaccaaaataatgtcactgaaaacactgttggtaggaggcactagtagtctgctcttgtaaacaatacagctggcttaggtactaaggaatcacaagttgggtaaagtgaaggaatggttttccaaatcaaaagaccaccatgataccaaacaccaacaagaaacagaactgacacaccatctcatctactggacaaaatctacttgttcaattgataacatgtgctccagtcaactaaaacagtggagaaatcttagaaagaaaacattcccttttgatttatgacacaatgtatagttaacaaatgtagaattttttcctgtctggaaattggcaaaatgataaatattactgtataagctctgggagacatctactctgatgagattttcagttgttttgttttggttttgtttataataattttgaacagctttgtatcacactgagttaggggaaaggagaatttacgagaaatgcaccctaagtgaggccagtgtataaggatgtaccacctcacatgtgtgggatagttttgcaagagggattaatggtcatctgaaccttcagaaagactggagtgggcagcagcaaactcccccttcctgagaaattgctaagtccttctgcaagcaacagccttgtgccatcatttggcaaaatcctcatcaaacaacttctttcattcctctgcttccacccagttgttgcagctcaaatttttattaggttttctggatgtaaacttgagatggctcccaatgcaaacagagaaaactcctgttacagtccatttaaataactgcccacttgaataggggaagaggaaacacattctgtatttattcaaaagcaatggagcctcaaacaataagtgaagattataatattcttgagggaggcaaaattttcagtttcaatataaactacacaattggttatctctgtaccactcagaaagtatcccagccaaatgagtgaaatatgctctggacagccaagatcctttacagaacagcaatcaaaacaaaggaaaaaaaagagataaaaatagaacatctctccctgacactagcccccaagcacaaagctataaacctatcagaagcgtaggtttaacatctcatccttcaggaaaatattaatgaagctataagacgatcagagcttggatttatgaggcatcagcttctttccaactccagataaacattaagctccagcttataagaggaaaggagttgatgagtctgggtataatcactttaagtaaatgtagtatccaaagtctcaaaaacaaacaactcaaaaaacaaataaatacataggaaaggggcagcaaacagctgcctactttacatgtaatctggtcaagcttcacacacctccatctgcaagaggctcctgaggaggaaaccaggattcacaaaggcaaacttccacccacattctcacagctggtcagtggaagagacagaatcaaacctaaggctcttctgccttttgccatgaaaatagcatataggtctgaagaagataataaattgttggagcaggaatagaggcacccagcacttgcctcctccacaaagaaggaccaaaacagcaaacagataaccacacgtcgaatagtgcatctaggataatacactggaattcagcagggaagtggtagggacactttgaagcatggaggtggggaaagcaaagcagctggtccacctaagattggtataaagccagaaggaactccccattgtggggaaaagataggcaagagattcccaacagtccacattcccaccacagactcctgcaatactggtcatgagagaaccccttggccttcacaggccctgagactagtacagggagctgcctggagtatacatgactgcattgtcctagagaggaaatgctggatccttctcattccttaagacccaagctgctatggcatggcaccattttgagagtccagcctccaccagactacattctgccctggagcccaatatcccctgcatctccacatccatggagtaccccctgagctgcccccatgtccacccagaggtctttagcatcacaacaccatctggacccagtggtttggctggatcctcagcactctagcccatgcagtgtcctatggccacacagagagcaggcagtgcaccacacaggaaggctaccctcagaacagagggagcccaagtgcatgctctccagagcctgggagccacctgcccagggctgctgccaccagaagcaccccacccctccagtagtggggccactgcacacctgcatgctgtccagctccagtctacagctcccagcgtgagcaacacagaagacgggtgatttctgcatttccaactgaggtactgggttcatctcactggggcttgttggacagtgggtgcagcccatggagtgtgagccaaagcagggcggggcatcgcctcacctgggaagtgcaaggggtcagggaattccctttcctaggcaagggaagctgtgacagacagtatttggaaaatcagaacactcccaccctaatactacgctcttccaatggtcttagcaaacagcacaccaggagattatattccgtgcctggctcagagggtcccatgcccaaggagccttgctcactgctagcacagcagtctgagatagaactgcaaggaggcagtgaggctgggggaggggcgtccgccattgctgaggcttgagtaagtaaacaaagcatctgggaagctcgaactgggtggagcccgccgcagctcaagaaggcctgcctgcctctgtagactccacctctgggggcagggcatagctgaacaaaaggaagcagaaatttttgcagacttaaacattcctgtctgacagctttgaagagagtagtggttctcccagcatagagtttgagatctgagaatggacagagtgcctcctcaagatggtccctgacccccaagtagcctaactgggagacatgtcccagtaggggctgactgacacctcatacatctgggtgcctctctaagatgaagcttccagaggaaggatcaggcagcaacatttgccgttctgcaatatttgctgttctgcagcctctgctggtgatacccaggcaaacagggtctggagtggacctccagcaaactccaacagacctgcagctgagggtcatgactgttagaaggaaaactaacaaacagaaaggacatccacaccaaaaccccatctgtacgtcaccatcatcaaagatcaaaggtagataaaaccacaaagatggggagaaaccagagcagaaaaggtgaaaattctaaaaatcagagcacctcttctcctccaaaggaacacagctcctcaccagcaacagaacaaagctggacagagaatgactttgatgagatgagaggagaaggcttcagatgattggtaataataaactactctgagctaaaggaggttgtttgaacccatcggaaagaagctgaaaaccttgaaaaaagattagacaaatggctaactagaataaataagcatagagagtaccttttttttttttgagatggagtctcgctctgtcgcccaggctggagtgcagtggcagaatctcggctcactgcaagctctgccgcccgggtttatgccattctcctgcctcagcctcctgagtagctaggactacaggcacccaccaccacacctggctaattttttgtatttttagtagagatggggtttcaccgtgttagccaggatggtctcaatctcctgacctcgtgatccgcccacctcggcctcccaaagtgcggggattacaggtgtgagccactgcgcctggcccaagaagaccttaaatgacctgatggagcagaaaaccatggcacaagaactacatgatgcatgcacaagcttcagttgctgattcaatcaagtggaagaaagggtatcagtgattgaagatcagatgaaagaaatgaagtgagaagagaagtttggagaaaaaagagtaaaaataaatgaacaaagcctccaagaaatatgggactatgtgaaaagaccaaatctacgtctgattggtgtacctgaaagtgacgaggagaatggaaccaagctggaaaacactctgcaggatattatctaggagaacttccccaatctagcaaggcaggccaacattcaaattcaggaagtacagagaacaccacaaagatactctttgagaagagcaactccaagacacataattgtcagattcaccaaagttgaaatgaaggaaaaaatgttaagggcagccatagagaaaggtcgggttacccacaaagggaagcccatcagactaacagtggatctctcggcagaagctctacaagccagaagagagtgggggccaatattcaatattcttaaaggaaagaattttcaacccagaatttcatatccagccaaactaaacttcataagtgaaggagaaataaaatactttacagacaaacaaatgctaggagattttgtcaccaccaggcctgccctaaaagagctcctgaaggaagcactaaacatggaaaggaaaaactggtaccagccgctgcaaaaacacgccaaattgtaaagaccatcaatgctaggaagaaactacatcaactaatgagcaaaataaccagctaacatcataatgacaggatcaaattcacacataacaatattaaccttaaatgtaaatggactaaatgctccagttaaaagacacagactggcaaattggataaagagtcaagacccatcagtgtgctgtgttcaggagacccatctcacgtgcagagacacacataggctcaaaataaagggatgaaggaagatctaccaagcaaatggaaaacaaaaaaaaaaagcagggttgcaatcctagtctctgataaaacagactttaaaccaacaaagatcaaaagactcaaagaaggccattacataatggtaaagggatcaattcaacaagaagaattaactttcctaaatatatatgcacccaataaaggaagacccagattcataaagcaagtccttagagacctacgaagagacttagactcccacacaataataatgggagactttaacaccccactgtcaacattagacagatcaatgagacagaaagttaacaaggatatccaggaattgaactcagctctgcaccaagcagacctaatagacatctacagaactctccaccccaaatcaacggaatatacattcttctcagcaccacatcacacttattctaaaattgaccacatagttggaagtaaagcactcctcagcaaatgtaaaagaacagaaattataacaaactgtctctcagaccacagtgcaatcaaactacaactcaggattaagaaactcactcaaaactgctcgactacatggaaactgaacaacctgctcctgaatgactactgggtacataatgaaatgaaggcagaaataaagatgttctttgaaaccaataggaacaaagacacaacataccagaatctctgggacacatttaaagcagtgtgtagagggaaatttatagcactaaatgcccacaagagaaagcaggaaagatctaaaattgacaccctaacatcacaattaaaagaactagagaagcaagagcaaacacattcaaaactagtggaaggcaagaaataactaagatcagagcagaactgaaggaaatagagacacaaaaaacctttcaaaaaaatcaatgaatccaggagctggctttttgaaaagatcagcaaaattgatagaccactagcaagactaataaagaagaaaagagagaagaatcaaatagatgcaataaaaaatgataaaggggatatcaccatcaatcatacagaaatacagactaccatcagagaatactataaacacctctacgcaaataaactagaaaatctagaagaaatggatgaattcctggatacatacaccctcccaagactaaaccaggaagatgttgaatccctgaatagaccaataacaggctctgaaattcaggcaataattaatagcctaccaaccaaaaaaagtccaggaccagatggattcacagctgaattctaccagagatacaaagaggagctggtaccattccttctgaaactattccaatcaatagaaaaagagggctgaggtgatggggttttctaaatatacaatcatgtcatctgcaaacagggacaatttgacttcatcttttcctaattgaataccctttatttctttctcctgcctgattgccctggccagaacttccaacactatgttgaataggagtggtgagagagggcatccctgtcttgtgccagttttcaaagggaatgcttccagttttagccaccacacctggctaattttttgtatttttagtagatacggggtttcaccatgttagccaggatggtctcgatcaggaaagggaattcttatacactgttggtgggaatgtaaattagtgcagccattgtagaaaacagtgtagagatatcaaaaaaacaagaatagaactaccatacaatctagcaatcctactactgggtgtttatccaaaagaaaaaaagtcacagattgcttgagttcaggagttcaagatcagcctgggcaacatggcaaaaccccgtctctacaaagaatacaaaaattaaccaggtgtggtaacatgcgcctgtagtcccagatacttagagggctgaggtggtaggatttctttagcctaggaggtagaggcatattatgccactgcactgcagcctgggtgacagtgagatcaggtctttaaaaacacacacacacacacacacacacacacacacacacacacacacacacacatacatgaaaggaaattagcatatccaagggataactgcattcccatgtttactgcagcactatttgcaatagcaaagatatagaatcaatgtaagtgtccatcaacaggcaaatggataaagaaaatctgtatatatacacaattgaatattattgagccatttaaaaagaataaaatcttgtaattcatggtaaatggatgagcttagagaccacaatgttaagtgaaatgtcaggcacaggaagatatgtactacatgttctctcttatatgtgggagttaataaaaaatttgagttcatggaagtagagagtagaatcgtgagtatcagaggttggggagagtaaaggggagagggagatagggaggatctggttaatggatacaaaattacagctagacagaataagttcaagtgttctatattgctgtagggtgactacagttaacaaaaatttattatatattttcaaattagtagaagaaaggattttgaatgttcatgatatgaagaaataaatgttcgagataatgggtatgctaattaccctgatttgatcattacacactgtatacatgtattgaaatatttctctgtatcccataaagatgcacaacatatagaataaaaaaagaatcaaacccaagttttcctggctcaagattacttatcttttcaccatgtcaggagggtgccccattatcaaaagtattatttacataacaaccttttaaaaaaataacttccccttcatcaatttaaaagctataagcatttcattttgtgcactttctagaaacttgtaccttaaaagcactgaggtgaatttattttctgagttgcaggggaaacagatagaacaggggtagagaaagatacaaccttgtgttcaccagaaggctgagacattaggatcctgaggccttcaagttgagtccttcctctaccattttggagctgtgtaatcttcagcaagttagtaaacctctctgaatctcagctgtcctcctttgtaaactggagtgaataatagatatcactgcatgtaataggcatcactgttcaaagtgtttgattagataaactaggtcttgcttggcacatacagaaggctgtgattttcagctattatttctgtattcatcaatcctaagatgcattttttttcacaatttaacattttttcagtgcatctgactgcctatggcatctgtgtcaaattttaatgtgtcactgtgtcaaattttaatgatgcatcttacaatcagtggagtcttgatttgatgaattgtggtcttgtaattatcagtactattattaccaaagagatctggccataaaataataatgagactgtttccacaagctgtagacaataagcaccttattattttataatagcatggcacaaatttcctgctggaagactctcctgggggcttccatgtaatggctaagatggatgaatattgccttctggcagtaatggactttctgtaggtctgtcttatgttaagcaatctcaagatgtgaaaatccagatttctgttttaaaaattaattagaaggtgacacttcaaaatagaagagcttcacaaaagtatccatttggagcagtatttctcaatatttctttcctcattacctccctccccaataacaaggctttttagacatttttgtcctaatcactcccccaatgaaattttaatattgaagacatactgtatacctatttatgtattgtttgtatattttttcttaacacatgaaatgatatataaaagatgtataaaagagtaccatttgttgcacacaccctctcattcaaattttcacccccttgagtacaatatctcctctttgagaatgcatacattagagacagaccttaaaggacatttaaaatatcgtatggctttggaaattttaatttgcactcaattttcctaggacacatcaactacagataggaaggcatacaagtatattagataaaatgtcaccgtggggtgtccactccatgttgattacaggctaatgtctgcctagttgttttttagaccatgctacccaaccaaaacaccaggaggaagggacacctgtgagccatttgtaattcctataatggaagaaaacttgtctcaaagttaagttgacttttaaaaatgtgcctaggtgttattcaatcacagcatttcatttgttaacgttatttctacaatggctcccaaatattttttcttttctcacattattatttctttaataccagaaatcaacaccctgatcaaaagtttccagaaatattccctatagttgaaccccaagggaaggattctttatatccatcatcttaagggccatggtcagacgaaagttccctgggccctcacctgccttcaggccccgggccttagaggaaggactcttgaagcagcacaaaaagctgcttcctgtttcccacttcccacttcctgcttctggcttcccacttcctgcttcctgcttctggctttggctgagcatccgaaggaggaacaatgctgggttcctgggctatggtgcttttgcctcagagtggatgggggaaaccgtggcagaggcttggtccagaagatgggcagaggtactcagggggccaggctcaggccaccccaccccactgctcaggagataggcagtttagtttgatgtttgaaataccatttcaagaggcccgccactccactatgaggtaaatagcctaaaatgttaaaaataaaacaaacatctccactaaaaatacaaaaattaggcagatgtcgtggcacgcacctgtaatcccagctactcaggaggctgaggcaggagaattacttgaacctgggaggtggaggttgcagtgagcagagattgcaccattgcactccagcctgggcaaaagagtgagactctgtctcaaaaaaataaataaataaaaaataaaataaaaataaaataataaaacaaaaaacacaggctgtgagaattttcatctgagttttagcttagtacaaggactctggaagactctggagcattcaccgtggctatcatctgtgtctttctgagccttgggaaaagcaaggtacctgcttagaggcttttctcctttctggggcttgatgaccttgtgtcacccttccatgcagtggaaggactattccactgtgacagtatttactctgttatgtaccccaaacctggctacctccatgcctcactgaagcaggcagggccagtgctgtccttgacactcctttttccttgtgcaatgctgtgttggggtctctgacttggaaggaggttggccaagttcaaggttcacaaggatgcctgtacccagccattctgccagcagactgcagacatatgagccagccaagctgagaacgctgagcctggcctaggtcagcagaacctccccacccaactcagaaatgacacactgacacatggttgtgtgtgtgtgtgtgtttcagagtctcactctgttgcccaggctggagtgcagtggcgtgatctcagctctctgcaacccccatctcccaggttcaagcaattctcctgcctcagcctcccgagtagccgggattacaggtacgtgccaccacgcccgtctaatttttgtatttttagtagagacagggtttcgccatgttggccaggctggtcttgaactcctgacctcaggtgatccacctgccttggcatcccaaagtgctgggattacaggcatgagccaccacacccggccggttgtggttttcaggcagtgtatttgggggtattgtgttgctcattgataactaattgaaacacctggagcacaataaacattgagtaaatgtagctagcatctttagctttttattcagctccccatgtaagtactggtttctccatggtgagcctccgccccttcctgcgtgactgtcctcgctagtccctgctggcctctgctgtccatgctaagcacaggttcaaccagcttcataggcactgaacatcctctgcgtcatgcttttcattcctgacacacagttcaaggaaaaacaaacccaaagtggcttttcctaatagaagaaagcgtagaatatataaattcccagaaccagattttcacacaatgaaggcaaggtgagaactccttgattccagccactgctgtctgatgtcagtttgacttccttttatttcttttaagcagggaaatgaacattaatcttcaccctcacaattgtcccaggcaagccacaaagtgctgagcacaaggggaaggctggctaagtatgtgtggagtggaattggattagatggggagaaactctggttacctctgaacttgatttctacttgggccagctatgtgccgtttgaccttggcccaaacagccctcctctctatctgtgctgcttcttctgtaaaataggaataattacgtcagctcaactcatctcatccattgttgcaaggagtaaattagatggcacgtgtgaaaatgctttgtaaactactgagaactgtgtaatgcattgtaaggcattgtcatgattgctactatttcaagtccaatgggggagattggatcgaagaagaatggcagacagcccagggttgtgggggcagtgaggctgacttgtttatcagtagaaaaagcattctgactcatctcagaaaagaatcttggcaaacacaaagaaaatagtctggagaaagctgatgagcccacagttggaattctgtattggggtttagaaatgtgagcaccaggatgctgaaaacatgagcaccaggatgctgaaaacattgaaaagagtccaggcaaaagcagggcagttactagagaacagaagtctcaacttgtgaagaattcagtgtgaaacacatgcgctttggccaccaggaaattatacttgtttgcccaagttttttccaagaggaagatgcttcagggatatgtaacacgctcttgtggaaagaatgctggtttataggcctctgcacagggactcccctaaacctctaccccaagtctggatgaagaaaacagtgagaggtgcaccagatgaggagccaaagcttttcacaagaaccaaataatgttttaccagttagggtgcttttggctgtaagtaatagaccagataacaaagaagctaaggtcatttattatttccttcacaagaagttcagagataggccagtaccaggcttggttaactcagcagtgcaacaaaatcctctaaaactcaattcctccccccttctctctctgcgatcctcgtgggcttgatttatccttttagggttggcttccctcatgatgcagagatggctatgacaattccaggcatgccatgtagatgacaacatctctgtccctttttaagagtaagggataatttcccagaggttccccagcagattcttacttccactgcccttgaccatgactgtgatctctttccaagctgtattagtccgggttctcctgagaaacagaactaataggagatagatatatttatgtacatacactcaagtgtgtatgtgtttgtgtgtgtgtgtatatatataaaataaagaattggcttacatgattatggaggctgaaatgtccccagatctgcagtgcaaaggcctgagattcaggagagctaatgatgttaagttctagcatgagtccaaagcagaagagagacgtcccagcccaaagtcaggcaggcagagagagcaaattctctcttgctcagccttttgttctaatcaggccttcaacagattggatgaggcccatccacattggggagggcaatctgcttcactcagtctaccaattcccatgctaatctcacctggaaacaccatcacagactcacccagaaataaagtttacccaaatatccagatgcctcatggcacagtcaagttgacacaacagtaaccatcacacaatcttaaactagccaccaacaaggggagtaaaatgactatgaatggccgagaccaatcccaattcactctagggctagagggggagctcagcccccagaagctcaaggccttccagtccctggacacagctggggttctgttggcaagtaatagggggaagagctgtggggcagtgaccaagaatggctgcaccctctgctccatgtaactcaccgaggaggtccccaaaatgtaatgcatgacaggatgttagctaacacttgctgggcacgtactctgcactaggtgtggtactaagcacttggtaggtgtcatctcattcaatcagtttaacaacctgaagctccttgtgttgggctttgttgggaggtgagatggaccttaataactgaatcttcctggaagagcccagggttaatcctcttaatatcaaattgctctccataaataactgctttgctgtggttcttgtgaattccttcttcttttctttctagtagttgacttcactttagacaactgcaatttctactctggcatgatttctcagaggcggtcctcaacaaacatgcctggggtcagggagagagtccagtgatatgaaaaactagcccagaatggaaaactccttgaagttctgcaattatatattattttttattttgtttttgattttttgaattgaatttgatttgttgaataaattaattcaagcaatacaaaagtactgttgagagcaagtgtgcctcccaccttagtccctgcccaaatcagctctcccatggatccattcatccttcccttcctagttattgataaactattgttacgcaaaggtctgtgccaggttcaagctgactcgtggagttccaatggagttatctttagttcttccctcccacacaggaagcacccatcaggtgccaagtcctaaacatccatcttgacaaaatctctgaagtcctcattccctgtttgtttattgtttctccttggactcattctgccagcctccagtggcctccatgacaacattgcctccttctctgttgtctccgtcttctttaagtgcattttttataaagatacactacgttataggtggaatactgtgtcgctccaaatgcacacgttgatgttctaacccagtaactcagaatgtcactgtagttgcaggtagggtctttaaagaggcaattaaatttaagtgaggtctttgaggtgagccctaatccaatctgaccggtgtccttaatagtaagaggtgattaggacacagacacacacagggatagaccatgtgaagacacagggagaagacggctatctacaagctgaggactgaggcctcagaagaaacaagacctagtgacgctttgatattagacttccagcctccagaactgtgagaacataaatttgtgtttgagccacacggtgtgtggcactttgttatggaaggcctcgcgggcaaacacagactacgtacaatccagccactcacttgctgaaagctctgtagtggcttctggctgtttaacagtgaggcagcactggcccacctctcagggcccttctgatctggcgtggacctgcctctactgtcccgcttgcttaccatccatgctctgggcttcagctcacactgggctgattcccatccagggaacacggctgtgcttccttgcctttcgcctttgcacaggctgttccctctgcaaaaaacatatttgcatttcccatcacgcccctcccatttctacctgttgaaatcacgtccatcactcaaacccagccacagtgccatctcctttagaaaggcatatgctttcctaaagccacaatctagttgggtccctccttttcacctccctcattgttacaggtagtcagacagcatgagcagggcagaagagggctctcccatccactaggaaggttgggtaatggttcagcaacgatcacaatgcctctctaaaaatggtaaattggcagccagtgccagggagaggccatttcctgctggcccacacctgttgcactaaagtgttcactgaatgcagacaccagggagaagcaacttcctgagcatatacataaagagacaaaatggcagagtatgaccttccaagggcaccccacaggaaagggaagaaagcctcagatgggcatgtgcacagcttcctaaacacactgtgggtgctcacttcccaagggtaaggggagcactgtgtatgtgggcagcccagcctaacggaagaatcgtggaaaaggggcagcctataaggccctagcatcaaggttaaacaccgcacttgttcttcaagtcacccgcttgggtttcttccaagcctactttcctttctttcctgttctaaagtcttttaaaataaacttacactcctgctccaaaacttccttggtctctttttctaccttatgcctctcagtcaaattctttcttctttttttttttttttttagatggagtcttgctctgtcttcaggctggggtgcagtgacgtgatctcggctcactgcaacctctgcctcccgggttcaagcaattctcctgcctcagcctcctgagtacctgggactataggcatgtgccaccacgtccagctaatttttgtatttttagtagagatggggtttcaccacgttggtgagaatggtcttggtctcctgacctcatgatccacctgcttgggcctcccaaagtgctgggattacaggtgtgagcgaccgtgcccggctaaattctttcttctgtggaggcaagaattgaggttgctgcaggcccatatggattcgccagtaactcagacatcttccaccagggtaacaccatcatcatttgtaaaagtctcatgccgggatcagacctgccccgtattctattcaggtgtgcactcagttgccttcctatttgacttgctcacctttcagcgtgtcatctaggaggactagacaagtagcacattttcacaaacacgaatggaatgaacatgacaggccagattggaaaataggatcaaaaataagtcaaaaaatgaaaattatgtctatggaaaaaaagaaataggaaacacgactcaaattgtgtcaaccctaggatgacctgcaggaagttgaaaccctgggtgggagaagtactgaatagaagagagaatgctgctcccctgacactgcagctatatcggaaaatacattctaagtctacttaagatagaattccggttgaatattctgaaatgtgttcttacatggaagacatttgacccctggagacaactcaacagaagctttgccttggaaagctggttggatggagaggttttgtgaggtctttttactctggaatctgagatgcctggtggaacttgagcagcactgttcagcagggggcaggccaccaagagcacacatatacccttaaaaaccatctgctctgcaaacatgcagaaatcattaatacattgcaagcgtggttttgcccagacctgctgcaaaatgatcacaggcaaagtggtttgcgtactctccccctcactgatggctctttgggccgtcagttgaacaaggaacccacacggagctaaaatgtacaaacgacaaataaaatgttgcctctctctccagactctcacaaaatcaggaaaaacaaaaaaaacctttctttccatttctgcaagaaagaaatgagagctaaaactgttagccatgtgaaatctagtggggaaacctgttttttttttcctatgagtcttaaagcagcaataatttgttttcctttcttttcctttcttttttctcccctctgccacattagagaggcttgctgacaaagacttgagtaggttctataaggagccccaggcatccccagatgtggtgcacattgagatggatggagaagttgtgtatggcggaggaaactaggagtgccgcaggatagaaatccactgggagtaagacgggttggtgtccctctggaatccgtgttgctgccactgctcggtagagaagggtgggtggagtcatgtccctggaacctgcctgacagtgttgccagttctcctgcttcacttctggggctgcccccgtgtccctgatgtcaaagccatgaagttacttctgggaggggagaaatcaagctggagaccctgagacaggggtgaaatcagaacctgctgcgctggtggaatttggcagatgcctccatgctgtgaaggggccatgggcaccgaaaggtctccccacccctgcaccctctcactctgatgccaagggcctttagttccccagaagcagaactggagctggggaagactacatgagggattcatgaagccagaattcttaggaggaggagggatcaggaagacacacggtggaaggcacggggctaggtggggatgtggcctctgctggagaccaacttctgccggatcccatggcagctccatcgggtcccttttgaggtgaggacattggccttttgtatctctatgttttgtctttgaccactggccatggtgatggtgttgggtgactgacaaggtagctctgtgctgggctgcacttccttccgctgaaagtcattaggatgcctcgcggctccttgtgaggttggacatggcggatgagcactgaaggtggcaggatgcttcagtacagagacagatggtagatgttctggcttttcaggccacctgatatggttaggctttgtgcccccactcaaatctcatctggaattgtaatccccataatgcccatgtgttcagagagagaccaggtggaggtaattgaatcatgagagtggttcccccatgctgttctcatgatggtgagttctcacgagagttgatggttttataaggggctcttccctgcttaactaggcattctccttcctgccacctcgtgaagaaggtgccttgcatccctgttgccttccaccatgattgtaagtttcctgaggcctccctagccatgcagaactgtgagtcaattaaacctcttctctttattaattacctagtctcgggcagttcttatagcagtgtgagaatggaccaatacaccacctgtggtctctgttgtatattcttttttgttttatttcaccactctttatagaaactccatcattggcctgagagccacacagaaacaatccctgattgactaaatccattaattcataagggattgcaaaatggtgatggcctaactcttcacgcttcattcactagctgaattatttctataaagaaaaagattctgccagtcacctatttaataccctgagggacagttcatttaggaaagacacgataaatgcttggatttttctgtttacttactatcttagcccattccaggctgctataacaatacacatgagactgggtgattgataaagaacacacactcatttctcaccattttggaggctggaagtccaggatcaaggcacctagagttttgttgtttgatgagggcctgttctctgcttccaagatagagccttgttgccagaggtgatcaatactgtattctcatgtggcaggagagatggaggggccaaaggcctggctagttccccagagccctttcataagggttctaatcccattcatgaaggcagagccctcacaatctaaccacctcccaaaggccaacctcttaatactgttatcacactgggtcttaggttcccatgtatgcatttttggggatacatacattcagatcatagcatgtactgattttaataataatgagtttgtttctagacattctccagagataatcaagattttttttttttcctcttagtataattgtgaacttagggatgtaagcatattgacaggttcaggatcaaatttgccatctttgggcagtttggcctctgaatatttttcaacagttttattgagatatataattcacatacagtacaaacacccatttaaagggcacaattcaatggtttttagtatattcacagagttgcacaaccatcaccacaattaattttagaacatttttgtcatccccgaaagaaaccctgtacccaccagcagtcattctccatttccctccacctacctcttccatccctgtaccccacccccagacctaggcaaccactaatccactttctagacgagactgttctggacaattcatatacactgaatgatataataggcggtcttttgtgactggctgctttcatttagtaaaatgttttcaagggtcctctacattgtagcatgtatcaatatttcatttcttctaattgccaattaatattccattctgtggatgtaccactttgtatttatccatccattggttgatggacatttggttgtttcctcttggcttctgagtctttttgatagctccctagcagtctttggcagcttccttcctttctagcataatacgaagttccagactcttcttatatatgtctaccgcaggcttgggaaaactcactctccaaggagcacatattcgttttaatgggaaatgcaatgtcaagataaaacctgggtgctagggatgtttattgttactgggctggtcattgattctaggacttgcaacagacagagacaaaacatttttttggttgtttacttgtttgtttatttgctgtttaagataaactttacctggtgaatgtcctgaagcttccagttcaaagttaggaccacagagtttttacttagcttcatcaatattacaattgtatttttttctatgctaaaatgtcagattctcagtgacaccaaagtaatgactcatttgcattatcccataagacacgcagacacaagtttcatgtcgcaatatcaaaacttgtgggagcaatgtatttactgaaaacagtttaaaatttgttcaaagttatttttgccttacagatttgtcactggagatgtacagttggaaatgtattttaacggcatttggaatagttcctctttgtggttatgctatcaactggttgccacttaagttcatttagttcactttatttttgatttttagagattgattttatagaaattaattttgttttctaattatgttctaaagttaaaactacaaggtaagatttattcaaagaagtccggcttctattcctgtcccttctattttactcccttttgtttcgataaggcaaccactaaagacaattatcttcttttactttaaattttaagcaaattctatatatatgttcaatcccccttcttagactactgtatttactattctccatcttgcttttctcattggaccataaatcttggagatcacttcataatggaaatctttcttagtcttttttaacagctgcatagtaccctaatactttctatatgcaccccagttaattcaccttgtacctgattgacagacatttggattgttccaagttttatgcagtctcacaaatagtgctgcaatgaatcgcctatacattttcagatttttgccagaatatcattggctaagagcatagaagtgggatagccaagctaaaggagcatactttgtgtaacttgggtttttctaaggcatgatttccgttaggggttgcaaaacggtgataggtatttaaattttatcattctttatttattagctagaacagctctataaaaagaaagctccccttaccacctctttgactacactgagggacagtccatttaggaaaggcaggacaaatgcttgattctttttacttactgattttcacaaaaatgaattggttctcaggcaacttccagaggtaatcaatgaagatttgtttgcccacatgtatcattatgaacatataaattcaatcatatttgatgtgtttaaatccaatgtcatcttagtataatattaatttcctttattataagtgaggttgggcaccatttcatgtgcctaagagtcagtcacattaattctttcataaactatctgctcatatttctagactactgttggtcaagttgtgagcctttttttctctttttagaatctcttttatatattgttattgacttttgatacatgtgttttttcttagtttatcatttcccttttctactttgcttatgctgttaatttttcataaaaaaggttttttggtgatcaaattaatcaaatgttatatttaatgcttcagatttcaagtcataattaggaaagttttcttcattcgcaggataaagaggaattcagccacatttccttctagtaccttatggtttggtttcgtttttacatttaaatacataccatttgaaatttatcctatcatatagcatgagtaaagattccattttattttcttccatatggctatccagttatcctaacaccacctgtgaaagagtctatcttttccctactgacttcagattttgactttattgtatactacattttaataatcacataagtctgtttctagagtttatattctgaatcatgtgtacctatttaagcattaatataaagcttttgaaatgatggcagctttgtaggaagttttaatatctgagaggtctttccaccaccctccctgccattcctctcctttcttaagctgctatgcttactcgtatgttaatacaaatacattctatataatcagcctgtctggcctaggtaaaaaacttgggaatttttcaactttgtattacattacatttcatttatatgttagcttagtgagttctgatttttttttttttttatgctgagtcttcctatacaaggacatggagtgtctttccatttgttcaagtctacttttgtgcctctctcgtgagtgttttatggttttcttcatgcaggttttgggcacttctttgctaccacaaatgtggtggtctcttctatcttcttactggtttttgtttacaatatatgatgagtatttatttttctttgttaattctaaaaattgctcccttcctaacactgctctcagtgttatagtatcttttcctttgattcttttgaattttccagatacataatcataaagtgaaaaattttttatattagaaactccaagggaatgtttgaaacacggatctctgagaaagtgtgtcccttgtgaaccatgggaatgaagtcaaggcagttgccacaacttgttggcaacatgctagaaaaatatatattcaaggaaaggaaatatagctttttaaggactctaatgacaatctcaaagctttaaggttggagacaacattgcaaaaatatagaattattaattgtctttgtctctctactctttttctgacagcccttccttctccatgtcctttactcctttgttttatatattgccacagcatacagaaatgttcttccctcacagatcctacatctttctaccttcttagcttcttcttttagctcctccttgctcttttgcctgcatcttctattccttttattcctctattttttttgtcatatgtgtttatttcccattggtaaggacattggagtataactagtattaagcaaaaaaaaaaaaaagtcaaatccagaaaatgtcttgaaatactattataaaacattacactatacatgtctttaataatgttcctagaaaaacttatttttgtgtaaaacacatagtacatagtacagcttatcctaaagattgtagataataagaataatggtgaaaatctccatttagtgggcaattcctaagtgccagatacaatgctgtgtactgtactaaaaactcatctattcattctataaatattgattgagttccaggcagtattcattctgctgtggataaaatagatgaaatctctgccctcattgaacttacattctaggaagaagacataaaatgatgaaatattataaatcaataagatacgatcaatgctagctctactcttctaggaggcagaggttgaagcaaggatttgggaggtgcaaggctggacttggagaatatagaaaggagaggagagagataagagatgtgaggctgggagactcaggcaggagaatcgcttgaacccgggaggtggaagttgcagtgagctgagatcgcgccactgcactccagcctgggtgacagagcaagacgccattaaaaaaaaaaaaaaaaagaaaagagagatgtgaagcaatgtgatgtatattgagttggctgcagcatcatgagctgccaataggcacagcaggttgcatcttctttggcttgtcagagttctagggaaggatggcaaggaggaactgcatcttggtatattcacaaaaggcaggggtttattagcctggctccctcccatcttctcttttgcattggtgaaaggccaccctatgtggaattaacttcctcacattgccagattgtaccttctggacctctggtcgtctaccggaaaaccacacccaacccaagtctagtggcagatgggtgacccagcagaagtagggtgctgaccaagagaaaggaagaagggtgaagtcgaggtgaacaaaatgtgctggcttgtgcccattgtggctgacacagtcctcaggagggagagacacaacagatgaaatcagagaggtaaggagggtggggagtggacagatcctgtggaaacttctaagttcttgcaaggacattgctttttactttgcatgagctgggaagccattgaagggaggtgttggagcagaggagtgacatgatgggactcatgcttttaaaggaccatgacaaccctgcaaagttagtaattcaggctttagaattgaaataatttcccgaaggtcacagagagaggtagtagagtcaggatttgaacccaggtcctcttactctaaagtccttgtgctatctagtaggggcatttcctttctaatatattagttgcaaactttttattcatttataaatttatatattgattttatgcctcctttttgagcctgtacatttctgcttgatggagagtagaatggtgttaggtctgtgtttcttcattcattccaaaaatatgcattcattccctgctgtgtgcatggcatcataaattgtgctacaaagaataaaaaggtggacaaggtcctttctctcaagaaacgtatagactagctataaagagaagacaggatttgtatttaaattatttaagtccaatgattttcacttttgggggggttcttgcttatttcatagaattccctaaaagaaaattgctatttcttttaaagaacagccccatctgagagctggcagcagacaaaatatgggattccctcttcgattttatagattttgacttccagcttgactgttcagttagcacattaaaagatgactccctccctccccaaccctaagcctcgcaaacccaacctgtgatcagaaaatccagctgtgcactttctatttcttgcctcattgccaggaataaagattcagcaatctctgcctaaccgacaatgttgtcagtgacacctgaggcaaagtaaaaacagctcagcagttctgcagccgctgagccgctgagctgctgtggcattgcattagtcaaagcaaggattcctaggcagcccccctcctccctcccatctctcactggggggcagcttctgctgcagtgggcaagaatattcagtatcagaatctgctcctctcattttgatgaggaactgtgacagggctaaatgtcaaatcttgatccaaagactgttctgtttgccttcagccagtatttcaagtattttcaggacttgagtcgtacagtcatgccctttgttttcctgcagaagactcaggcaagcaacacattttaggacaacagccctggataaggattcaggacacatgggcttcagatctgcctctagcaccatctgcctgtggactgcccactctccaaggagtacgccatgaaggcctctaagttcctgtaccctacatgagctttgtttgggtcttgcagaatccccaacgggaggccaacagagtcatacctggcctttgcagctctgaaaattcccacatgagaaagcgcatccatattccgcttgagtttgcctcctttttctgtgtgaacatgcaaactctctctggctctacagattagaataaaccctctcatgacccttaccagaaatacacaacgattttcatcttagccagtttgttctcagctaatacatccttttgagcctctttgtttttttgtcttcatatgcatttgtttattttcctttggtagaaacattggagtataattaggactaagctgtggttttgtatagctacccttaacattctatatcctggacttgttatcctttgcttatgactgttatccacaggttcttcttacatggctgtgcaagtcacttattcattcattcgttcaattaatatatgtttattaagagtttattacatgccaggtgctatgaaacccagcatccaccctgcctctcttgggaggctgatggttctggggtttatatatatgcctattcgagtatctttcctatttgaatatctttgctgtgatactcaaataggaatagatactatttaagtgtcacaggaataggcatatatatatagacctataatgcctatttgagtatctattcctatttgagtgtctttcctgtgacaactttacaaaaaaagatgactttcagagagctataactttttcttcgtttttactgatcatgtttctataccttaaaacttctccaagattcagtatttagaagttattacaaattcttcatttatttgtatggaaaaatctacttagcaatggtgaacttttttttatccccaaagtaccaaaaaagatagaaatgatttaaagaaagattacttttaatttcgattttttgttgttgttgagatggagtttcgctcttgttgcccaggctggagtgcaatggcatgatcttggctcactgcaacctctgcttcccaggttccagcgattctcctgcctcagcctcctgagtagctgggattacaggtgcgtgccaccgtgcctggctatttttgtatttttagtagagacggggtttctccatgttggtcaggctggtctggaactccctacttcaggtgatctgcccaccttggcctcccaaagtgctgggattacaggcatgagccattgcgcccggccttaatccaccacccgcccttttttttttttaaataagttgtttggacaagttcctctgagctacaaaatcgtaaacaatagtgatatcagttttgaaataaaactgaggatttctacctagaataaaatacacttgaagctgcagaacttagcctgccaaccaaatagttttgcactgattatgaaaaaagcatcattctttttcatgtgtagcaattgaatttacttatgtatctgccaaatcgcatataagcataaacatttagttttcaattctcatatcctttcaatttatttgtcattaaaaatgtatttttattgtcaattcccatttaaattaaattgtgcatgtgtgtgaagtgtgtattcaaatgaaggtgatatagtatattgtggtagtagaaggatactgaggcttgggatgaagagtttaatgtgtaatctagactaccacatttcttctgatgaaaacagtcccacatctatcctaaaccatcaggcactttcagatttcttctttctttcctatgtgaggctcagcagaagtgtagtgatgatagaagtaagaacgggcagaactaaatgcagggagtgttaacaatacaggcatacttattgtcttacacctcaccgtgctttgcagatagtgcgttttttacaaactgaaggttggtggtaaccaggcatgaagcaagtctcttggtaacatttttttccaacaacatgtgctcaccttgtgtctctgtatcacattttggtaattcttccaatatttcaagctttttcattattattatacctgttatggcgatctgtcatccttgagttttgatgttactattgtaattgtgttgggttaccataaaccgtacccatatgacagtgaacttaatcaataactcttgtgttttctgactgctgcactgactggctgttcccctatctctctccctctccttgagcctccctattccctaagacataaaaatattgaaatcaggtcaattaataactctacaccggcctataagtgttcaaatgaaaggaagagttgcatgtctgtcactttcaatcaaaagccagaaatgattacgcttagtgaggaaggcatgtcagaaactcagacaggccgaaaactgggcctcttgcaccaaatagccaagttgtgaatgctaaggaagagttcttggaggatattaaaagtgctactccagtgaacacatgaatgacaagaaaatgaaacagccttattgctgatatggagaaagtttgagtggtctggatagacgatggatagaagatccaagcagccataatgttcccttaagccaaagtctaatccagagcaaggccctaactcaattctatgaaggctgagacagatgaggaagctgcagaacaaaagttgaaaggtggcagagattggcttatgaggtttaaggaaagaaaccatctccagaacataaacatgcaaggtgaagcaggacgtgctgatggaaaagctgcagcaagctatctagaagatctagctaagacaattggtgaaggtggttacactaaacaacagattttcaatgtagatgaaatagccttctatcggaggaagatgccatcttggactttcacagctagagagaagtcagtgcttggtttcaaagcttcaaaggacatgctgacttttttgttaggggccaatgcagctggtgactaggttgaagccactgtttatttaccatttggaacattgtagagcccttaagagttatgctaaacctattctgcctgtgcttcataaatggaacaagaaagcctggatgacagcacatctgtttacagaatgatttactgaatattttaagcccactgttgagacctacttctcagaaacaaagatttctttcaaaatattactgcagatttacaatgcacctggtcacccaagagctctgatggtgatatagaagaagattaatgttattttcatgcctgtgaagacaatattcattctgcagcccatggatcaaggagtaactttgccttttgagcattattatttaagaaatacatttcataaaattatttggctatggatagtgattctactggatctgggcaaagtaaattgaaaacgtttctggaaaggagtcaccttccagatgccattaaggacatttgagatttatgggaggtggtccaaatatcgatattattaggagtttggaagaagttgattccaacccttatggatgacttggaggagttcaagactgcagtggaggaagaaactgcagatatggtggaaatagcaagagaacttgaattagaagtggagcctgaagatgggattgaattgctgcaatctcctgataaaacttgaatggatgtggagttgcttcatatggattagcaaagaaagtgttcacttgagatggaatctactcctggtgaagatgccttaggtgctgttgaaatgacaacagagtatttagaatattaaacaaacttagttgataaagcaggagcttgagacaattgactccaattttgaaagttctactgtgggtaaattgcatgctacagagaagtcttccatgaaaggaagagtcaatcaatgcagaaaacttcattgttgtcttattttcagaaattgccacaaccacccgaaccttcagaaaccaccatcctgatcagtcagcagccatcaacattgaggcaaagccctccaccagcaaaatgattttgacttgctgaaggctcaaatgatcattagcatttttagcaataaagtatttttaaattaaggtacatgtggctgggtgcagtggctcatgcctgtaatcccagcactttgggaggccgaggtgggcggatcacaaggtcaggagatcgagaccatcctggctaacacgctgaaaccctgtctctactaaaaatacaaaaaattagccaggcctggtggcaggcgcctgtagtcccagctactcagaaggctgaggcaagagaatggcgtgaacctgggaggcggaggttgcagtgagcagagattgtgccactgtactccagcctgggtgacagagcgagactccatctcaaaaaaaaaaaaaaaaaggtatgtacattttttaaaagacataatgctattatacacttaatagactatagtacagtataattataacttttatattcactgggaaatgaaatcttttgtgtaacctgatttattgcaatattcactttattgtagtggtctggaattgaacccacaatatcttggagggatgtctgcagcataattcacattctaccatatctgaaatcagaacgtgtcttacagttgacaggacgtgtcttagatctgatgaaatatagttattagtgggctggacagcaggaatcttactgcttgttgattgagtaactgtgatgatgcctgtttcagcttggaatctccaccatctctagtatattgccttacacacacacagtagattctcaaatatttgtcaccgaaggcaattattgataaaatatacatgaataatactgaattattaataactttagagaatagtgttagctaatttaattagttagaatggaggactgtttgtctaggttaggttaatagtctcatttgaatacttttgaatacatttatgtggtatcaacttatggcctctgctttgatcagtgaattaaataaacccattaaaatgtttcccagttccctttaatttgaaagtcttagagatattacttttgggccttcagagcattcccaggtatgatgattcctgagaagtcagctgatttctaggatcacctgacagtgagaagatacctgggggtctacttaggatggagatgactcctagggttgtttagttagccttcaaaaaaaaaacaaaaacaaacaaacaaaaacaaaacaccttttgagtgcctctcatgtgcactgggatacagtggtgagcaagacaggtgaggtctgcgttctggtgaatgttggcatgatgtatgcaaacacaccagtgcgatgctcaccattcagtaggtgtgccataggtgttagtttctttgttccagatagagtttctaagctgaaaatagcagggaaaccagcttctccccatctgcattctcaactggacttcaatcccatggtactgttttcttgtggcaagacttttgctttggtactctagaaaaagacatgtgcctgctacttatgagagcctggcgggaagaagctgctgcagacatctgtacacattaaaatctaagaaaatgctcccaatcctttaagaaaaccattacttggctcactgcaagctaattgcatttgttcagtcattgtgaaaatggatgcagattgggataagctaagaaataccctactattaaatcacaaaatagagccacttcttcaggagacaccatggcctgagatgaggctttctccaagaagtgggaaattgcttggtaaatttctcttttctgcttaagtaactcttttaattaatttttactgacctactcctcctttgacataaagggagtgggcatataaagaattgggctttgctggcagtaccttccagagtcaaaaagtgaagataagggagatggatttgttctttcaatttgaaacagagctttggtgtgttaggatctgcacctttgttaattagccacaatggacacaatgttattttattttcttatttctgcaatcatctgataagagcttacttttgaaataaaatgttatgatgcaataacaatcacattttaatggaaagaagtacacaacattaagataaaaatacttgagatatctctatttaaaggagaggggttaaaacatgtatctatgattcatagtctgaccttgaaaagttagccaccttgttagcctcatggatactctattgtgaaaagattgcaaaagtccttcggctaaaaccttgttcaaagtttgcccatatataaaaatagatattataatttaaaactgatgatagttttgtactattgaccaaatgagacacacagcactgaagtttatggactttataattatttatgcttttcagagttttaatgattcagtaaagggtgaggacagtctctccaaatcacagcaggcctaacaattctccttcctgggtagccaagtccatctgtttttaaactgggagggagctgctgacactttattaagctgttgttttgcttaaattgcagttatctaaagtgacacttcccctccagtcctgctttccaaagtgtagcaaccgtaacatacacaaacatacgtggctgcccctccagttgattaatatacagagtcaatatttttgctttattttaaagcatcacagcatgtggctgtgtttcttggatatttactttttctacctctcttttctctttttttcctttcactcctgacataagagtggatacactgaatattctacttctagcaagaggaagtcctgtttgctgtttgtgtaaacacttatgctgattacaacctccagaatccttagacatattcatcgttgcaggtctcaaaatgatacagaacaatggacttctagactcagtgacttacctccttagtgaagaaatcttttcctgaaatttcagcttcattatttttcttctgactgcggttttcctgcatgtcagtttacgttgatctggtctgtgaacctgcacctctcttctgcagagatgccttgctgatccatgtggatggacatttcatgcgcaaacagaggtgctttaagtgccgtggtctggctgagccaccgcatctaaacagcatctgctaggaatagttttcaaaggaatcatcagattctagagatggagcctcagttgcatgctcttgatacttatgtgcatgttttttatttacagatttcttttttttttctttttttttttttgagatggaatctcactgtgtcacccaggctggagttcagtggcgtgatcttggctcattgcaacctccacctcccgggttcaggcgattctcctgtctcagcctcctgagtagctgggattacaggggcatatgaccacacccggctgatttttgtatttgtagtagagacaaggtttcaccatgttggtcaggctggtctcgaactcctgacctcagttgatccacctgcctcagcctcccaaaatgttgggattacaagatttcttcagttaactttcagccattgtttgccgaagaaaaatgaaagacataaaataaaatgaggataagtacaatggtcttagaagaatcagagaagataaacactttgcattccaaatgtttggaatcttcccttctctcactccctcgagtttcgttatttccttttcatttacttactggtcaaagcccacagtcactgtgctggtggcagagaacctgacttagatggttttccatcttcaggtaagaggattaacaggaaagatgtgtggacagagttctggggacttgggtgtgtgagaggtaggacttggcagtccagggaagaacctggaaaatctcatggagcctgagaagcagactttcaagagaaggaaactcctgcagcatggtgttaaatcctccaagtgtgtttgcagatgtagaagtacgtgtgagtgagatactagaattaaatcatgcaaaagagcaggcaaattgtccacggaagaaaccagggcaccagcaaagtgggaagccaaaaaatgagcacacccttattcctagttattgtgaagccaaaataatccttaggtattgtacttcagaattacattgcaaaaatttatttttgcctgtaataatgcattctacactagcctagctcctgcattttagaaaggcacagtcccctagatgtgtggacatcaaggatgatatactttgcatgctcaggctccaatggcaagaagattcttcttacatcctgtttctaggaactcttcccacacttcctatcctcccaggcctctctttcagaaggtgtggggttaatagacaagagagagggcagggaattagagaggaggcaatcttgccctccacatttcctcttttgacctagccccacagactttctgaaatgatcccaaccaggttacccacaggacaagtcttagtaagagctaaaaggtagttcttgtgcctcccctgttgaacatcaagttgctactcttagctttggctgaaactccattcatcaggataaatgtagacttcaaggcttgctatataaatataatgggagacagcaggttggtataaaaggctttccaccaaagtacacattatggaatcagattctatcctgttttataaaaataaactgtctagacaaaaagaggggaaaagaaaagctagattctagagatcttggttaaacctagggacttaactatttttttttcatcaggtttgatttattgaaggtcagggcaaaaactgaccttaaaggtcagctagttctatcccatcatttcgcaagtggggacagtgtgcccctgtctcaggttagtacttttatagaacattaggacagtgaggttagtaccttgctaaggatcatcgagctggccaattgcagaggtgggtctaggaccaggtcccctgattagcagccctgtggttttttttttttcattgcaacatatttccaatgtccccagaagtgaaatgaaaaccatgggttatcttacctgcccaggctcttcacagaggttacctaaatggggatcagagtggggagggtaatgaattgggaaacctaagaaagaattgcagagcaaacccatcagccactccctaattacctctttctgtaaatcctctccaggagcctacatctacaactcagctggggcttaatgtgactatatttgataactttaaagttctcaatgctttaatacctgtctaaatttgatgactttaaagttctcaatactttaatatctgtctaaatttgattaatttggggctatctgttctagttggattttttaaaaaattcagatattgtctgaaccattgtgttatgccttgtcttccccatccttctttttttcctcttaggttctatgttttcaaactcagaaaccacgcagaaacccacagatctttgcaaccccacaggttagaaaatctcttgtgaaccctcaccaccagggccctgggtctgatacacacagctgtgtagagtcttagcggaacagtcacttgggcttacacagagacctaacagttttacagactctggccccagggatcctggcatggtgggagttcgacctgtacattcccctaagaagagggctgaatccagggagccaagcaaccttgttccacaggccctacttctatggcacctcacaagttaagattcactggcttgaaattcctgcccgccagtgcctcaggctggagactgcctgagatgaatgagttccagggggaaggggtggccaccatttttgtggttaggtcagctcagccattctagcctgctggctctggggagcctaggtggtcctgatgtggaggaatcccccacaatgcagcacagctgctgtgccagattgtggccagactgcttctttaagtgggacaccaatccatccctcctcactgggtggggcctccctgtgggaatttcagcaagtccagccagggttatatggacagaactctgatatctccttgggatggagttcctgggaggaggggtggttgaggtctgtgcagttcagttgactcagcctttccagcctgctggctgttgagagtccaggtggtctaaacatgaaagagttctccacaatgcagcacacttgctctaccaataatcagccagactgcttctttaagtgggttcccgatcccgtccctcctgactgagtgtgacctccaagtaagagtctccagatacctcctacagaagtgtctaagcccgcaacaggtcagtcccaccctgggatggagctccaagagaaaggagcaggctgctgtctttactgtttcacagtcttcactggtgatacctccaggtaaaggaaaactgaggcaactagggtctggagtgattccccagcaaaccacagcagccctacagaagagtggcttgactattaaaagaaaaacaaacagaaaacaacaacaacatcaaaaaagaccccacaaaaaccccattcaaaggtcagcatctttaaaaatctaaggcagataagcccacaaagataagaaagaatcaacacaaaaatgctgaaaactcaaaagccagaatggctcttctccaaatgactgcaacacctctccagcaagggcacagaactgggctgaggctgagatggctgaattgataggattaggattcagaaggtgggtaattgtgtaattcactgagctaaaggatcatgttgtaacctaatgcaaagaagttaagaatcatgacaggagctgataatcagaatagccagtttagagagaacataactgacctgatggagctgaaaaacacaagaaattcacaatgcaattacaagtaccaatagcaaaacagaccaagtggggaaaagatctcagagcttgaagactatctttctgaaataagatacacagacaagaatagagaacaaagaatgaaaagaaatgaacaacacctccgagaaatatgggactatgtaaaaagactgaacctatgatcgattggggtacctgaaagagatgggagaatgggccaagttggaaaacatacttcaggatatcatccaggagaacttctccaatctagcaagacaggccaacactcaaattcaggaaatgcagacaacccccgtaagatactccacaagaagatgaaccccaagacacataatcatcagatactccaaggtcaaaatgaaagaaaaatgttaagggaagctagagagaaagaccaggtcacttacaaagggaaacccatcagactaacagtggacctctcagtggaaaccctacaaaccagaaaagattgggggctaaatttcatatctggccaaactaagcttcttaagggaaggagaaataagattcttttcagacaagcaaatgttgagagaattcatcaccaccaggccggccttgcaagagctcctgaaggaagcactaaataatggaaagaaaaaactgttaccagccactacaaaaacacactgaagtacacagacaagggacactatgaagcaaccaaataaacaagtctgcaaaacaacaagctagcatcatgatgacaggatcaaattcacacataacactacaaaccttaaatgtaaatgggctaaatgccccaattaaaagacacagaatggaaagctgcataaagagtcaagacctataggtacgctgtctttaggagacccatctcacgtgcaaagacacacagaggctcaaaataaagagataaaggaaaacttaccaagcaaatgaaaaacagaaaaaagcagggattacaatcctagtttctgaaaaaacagactttaaaccaacaaaaattaaaaaaaatacaaagaagggcattacataatggcaaaaggttcaattcaacaagaagagctaactatcctaaatatatatgcacccaacacaggagcaccagattcataaagcaatatcttagagacctacaaagagacttagactcccacacaataatagtgggagactttaacaccccactgacaatattagacagattattgagacagaaaattaacaaagatattcaggacctgaactcagctctggatcaagcagacctgatagatatctacagaactctccaccccaaaacaacagagtatacattcttctcatcaccacatggcacttactgtaaaactgatcacataattagaaataaaacaatcctcagcaaatgcaaaagaactgaaatcataacaaacagtttcacagaccacagtgcaatcaaattagaactcaagactaagaaattcactcaaagcctcacaactacatggaaattgaacaacttgctcctgcatgactcttgggtaaataatgaaattaaggcagaaatcaagaaattatttgaaaccaatgagaacagagacaatgctccgtaatatctgggatgcaggtaaatcagtgttaagaggcaaatttatggcactaaatgcccacatcaaaaggctaggaagatctcaaattaacctaacaacacaactaaaagaactagagaaccaagagcaaacaaacctcaaagctagcagaagacaagaaataaccaagatcagagcagaactgaaggagatagacatgaaaaccccttaaaaaatcaatgaatctgggagctgctttttttggaaaaaaaaaaaaatagaccactagctagactaataaagaagaaaagagagaagaatcaaacagacacagtcagaaatgataaaggcaatatcactactaatgccacagaaatacagacaaccatcagagaatactgtaaatacctctgtgcgtataaactagaaaaccaagaagaaactggtaaattcctgaacacatacaccctcccaacactgaaccatgaagaaaatggacccctgaatagaccaataacaagttctgaaattaaggtagtaataaatagcttaccaaccaaaaaaagcccagaaccagacagattcacagctgaattatatcagaggaaaaaagaagaactggtaccatttctactgaaactattccaaaaattggaaaaggagggactcattcctaactcattctatgagggcagcctcatcctgacaccaaaacctggcagagatacaacaaagaaagaaaaagtcaggccaatatccctgataaacactgatgcaaaaatcttcaataaaatactggcaagccaaatccagcagcacataaaaaagcttatctaccacgatcaggttggcttcatccctggatgcaaggttgcttcaacatatgcaaatcaataaatgtgattcatcacatgaacagaactaaagacaaaaccacgattatcttaatagaagcagaaaaggccttcaataaaattcaacatcctttcatgataaaagctctcaataaattaggtattgaaggaacatacctcaaaataataaaggccatatatgacaagcccacagccaatatcatactgaatggacaaaagctggaagcattccccttgaaaactggcacaagacaaggatgccctctctcacttctcctattcaacatagtactggaagtcatggccagggcaatcaggcaagagaaagaaataaagcatattcaaataggaagagaggaagtcaaattgtctttgtttgtagatgacataatcctatttttagaaaatcccattgtctcagctccaaagcttcttaagctgataagcaagccttcaagatacaaaatcaatgctcaaaaattgctagcattcctatacaccaacaacagacaagcagagagccaaatcatgaataaattcccattcaccatagctacaaaaacaataaaataactaggaatacagctaacaagggaaacaaataacctcttctaggagaaatataaaccactgctcaaggaaattagagaggacacaaacaatggaaaaccatttcatgcacatagatgggaagaatcaatattgtgaaaatgcccatactgctcaaagtaatttatagattcaatgctattcttattaaacttgatattcttcatagaattagaagaaactattttaaaattcatgtggaacagcaacaacaaaaaattcatatagccaagacaatcctaagcaaaaagaacaaagctggaggcatcatactacccaactttaaactatactacaaggctacaataaccaaaatagcatggtacttgtacaaaaacagacacatagaccaaaggaacagaatagagaactcagaaataagaccacacacctacaaccatctgatctttgacaaacctgacaaaaacaagcaatggggaaaggattctctatttaacaaatggtgctgggagaactggctagccatatgcagaaaattgaaattggaccccttcctcacacatacaaaacttaagatggattagagacttaaatgtaaaacccaaaactataaaaagtctggaagacaacctaggctacatgccattaaggacataggcacaggcaaagatttcttgactaaaatgttgcttttgttgcaattgcttttggcattttatcatttcaaacgagatctaattaaactaaagagtttctgcacagcaaaaacaaaacaaaactatcatcagagtgaacagacaacttacagaacgggagaatttttttttgcaatctatacatctgacaaaggtctaatatccagagtctacaaagaacttaaacaaatgtacaagaaaaaaaaaaccctattaaaactgggcaaaggacatgaacaaacatttctcaaaagaagatattcatgtggctagcaaacataaaaaaaagtcaacataactgatcaatagagaaatgcaaaaatcataatgagataccatcttatgccactcagaagggcaattattaaaagtccagaaacaacagatgctggcaagtttgcagggaaaaaggaacacttttacactgttggtggaagtgtaaattagttcaaccattgtggaagacagtgtgatgatttctcaaagatctaaaggcagaaataccatttgacccagcaatcccattactagttatatacccaaacgaatataaatcattctattataaagatacatgcatgtgtatgtttattgcagcactattcacaatagcaaagacaaggaatcaccccaaatggccatcaatgatagactggtacatatacaccatggaatattatgcagccataaaaagtcaaaaaaaggacaagatcatgtcctttgcaagcacatggatgcagctggaagcttttatcctcagcaaactaacacaggaacagaaaaccaaacactgcatgctctcacttataagtgggaatggaatgaagagaacacatgggcacatgtggggaacaacacatgctggggcctgtcagagatgggggtagtgggaaggagatcatcaggaagaatagctaagggatgctgggcttaatacctaggtgatgggttgataggtgaaacaaaccatcatggcacacgtatacctatgtaagaaacccacacatcctgaacatgtacccctgaacttaaaagttgaaggaaaaatagaaaaagagctgtaaacgtattagattctgcagaactgggccctacattttcattcattgagagtctcaaaggtctgttgaaaaaacctaaaattaacaaaggttttatttgggaaaacgagttaatttttgtcagaactaatgatgttaaagaaaaaaagctatcatttcaagcaaaggggaatggttttctgtttcagaattttctagtagttctctccctcttggagtacaatcaagtgtcataatattgttaattgctctgtgttcttctgggtgctgcagtatattgagtaaaatgttagaatgttatggagtagatgaccagtttacttgactacaaatgagaagatgaacaagctgctttttgtctttactaactaaccatttgttctaggagctcccattttcaggttattttaatgagtccgtcaaaccagggggtatggtggatggaataggcagctgcaccttgtgcctgggaaacatagcacttttggaacatggatctccacactcaaaaatacttccatgttatatgggaatcatgggatttctgaactgaccaaatcctcagattatatctgatcctctctcattttaaagccaagatgatgaaggtgtagagtgactgcaagtcctacatagaccatgaatccagagcccatttcctgacttctgttctgcttattgaagagagggctgttgcctttagtctggggacatgaagacacccagatcagtgttttcctatctccagactaaatggaagtgctagtgagctaacaaaatgccagtgggcttttgagatgtctggagacagtttttatttgttacatctgggcaagatgctactggcatctagtaggtagaggacaaggatgccaataaacatcctaaccagcgcaggaaagcctcgaattatccagccagaaggccagtagtgcccaagttgagaaaccctgctccaggggagttgttgaactttggagttgacaagacttggattcaaaccctgatctgctggttgctggctttctgggtaggctaatcgatctctttatatttcagttcctcctctataaaatgggcttcaccatagcaccaattgcataggattgtcacgagggttaaataagatgctgcacataagacacggggatttgcacacagctggtgctaaatcagtgttacttactgatgttattaaaacctgcagaaatgaattttcatgctattttggttactgtagccctgtagtatagtttgaagtcaagtagcataatgccttcagctttgttgtttttgcttaagattgccttgcctattcaggctctttttttttttattccatatgaattttaaaatagtttttttctagctctgtaaagaatgtcattggtagtttaatagtaatagcattgaatctataaatcactttaggcagtgcaaccattttaatgattttgaattttcctatctatgaacacagaatatttttccatttgtttgtgtcatctctgatttctttgagcagtgttttgtagttctccttgtcaagatctttcacctcattggttagctgtattcctaggtattttattctttttgtggcaattgtgaatgggactgagttcctgatttagctcttggcttgactgttgttgttgtataaaaatgttagtggtctttgtacattgattttgtatcctgagagtttgctgaagttatttatcagcttaaggagcttgtgagctgaggtgatgggattttctagaaataggcttaggttgtctgcagacagggatagtttgagtctccctctttttattcggatggcctttatttctttctcttatctgattgctctggccatgacttacaatactatgttgaataggagtggtgagagagggcatccttgtcttgtgccagttttcaaggggaatgcttccagcttttgcccattcagtatgatgttggccatgggtttgtcataaatggctattattttgaggtatgttcattcaatacctagtttattaagagtttttaacatgaaggggtgttgagttttattgaaagccttttctgcatctagtgagataatcatgtggcttttgtctttagttctgtttatgtgataacatttattgatttgcacatgttgagccaaccttgcatcccagtgataaagcctacttgagcacggtgagtaagcttttgatgtgctactggattcggtttgccagtattttgttgaggatttctgcatcagtgttcatcaaagatactggcctgaagttttctttttttgtgtgtgtctctgccaggttttggtattaggatgatgctgaattcacaaaatgagttagggaggaatccttcctcttcaatttttcagaatagttttagcaggaatggtaccagctcttcattgtacatctggtacaattaagctgtgaatccgtccagtcctgggctttcttttttttttttttttttggttggtaggctatttattactgattcaatttcagagtttgttattggtcttttcagggattcattttcttcctgactcagtcttgggagggtgtatgtttccaggaattgatccattttgtctagattttttagtttgtgtcatagagatgttcataatattctctgatgattgtatttctgtgggatcattggtagtatcccctttgtcatttctaattgtgtgtatttggattctctctcttattagtctagctagcagtctgtctatttttgttaatttttctcaaaaaaccaacttctggatttgttgatcttttgaatggtttttccatatctcaatctccttcaattcagctctgattttggttatttcttatcttctgctagctttggggtttatttgctcttggttctctagttcttttagttgtgatgttaggctgttaaatcgagatctttctaactttcagatttggaaatttagtgctataaatttccttcataatcctgccttagctgtgtcccagagattctggtatgttatatctttgttctcattagtttcaaatacttcctgatttttgccttaatttcattatttacccaaaagtcatttaggagctagttgttcagtttccatgtaattgtatggtttcagtgaaattcttagtcttgatttctaatttgattgagtaatgttctgagagagtggttgttattatttcagttcttttgcatttgccaaggagtgttgtgtgtttgattatgtggttgattttagagtatgtgccatgtggcaatgagaagaatgtatagtctgttatttttgggtggagagttctgtagatgtctatcaggtccatttgatccagtcctgagttcaggtcctgaatatctttgttaattttctgtctcaatgacctgtctaaactgtcagtggggtgttgaagtctctcactattattgtgtgggagtctaagtctctttgaacatctctaagagcttgctttgagtgttcctgtgttaggtgcatatatctttaagacagttaggtcttcttgttgaattgaatcctttaccattatgtaatgcccttctttgttttttttgatctttgttggtttaaattctgttttgtctaaaattaggattgcaaccactgcatttttctgttttccatctacttggtagatatttctctatccctttattttgagcctatgtgagtcattgcatgtaacatgggtctcttgaagatagcataccaatgagtattggttctttattcagcttgtcattctgtgccttttaactgggggcatttaacctgtttacattcaaggttagtattgctatgtgtggatttgatcctgtcatcatgatgttaactggttattatgcagactttatttgtgtggttgctttatagtcactggtctgtgtacttcggtgtgttttagtagtgactagcaatagtctttcctttccagagtcagtgcctccttcaggagctcttgtaagacaggtctgatggtaatgaattccctcagcatttgcttgtctgaaaaatattttatttcttctttgcttatgaaacttaatttggtcagatatgaaattctgagttggaaattcttttctttaagaatgttgaatattggcctccaatttcttctggcttgtagcgtttctgctgagatgtctgttgttaggctgatgggcttccctttgtaggtgacctgacctttctctctagctgcctttaacacttttcctttcattttgacctgggagaatctgatgattatgtgtcttggggatgatctcctgaggtaacttactggggttctctacatttcataaatttgaatgttggcctctctggctaaattggggaagttctcccggatgatatcctaaaatatgttttccaagttgcttacactctccccatccttttcagggacaccaatgagtcatagatttggtctctttacgtaatcctatatttctcagatgttttgtttgttccttttcattcttttttctctattcttgtcctactgtctttttttcagaaaaccagccttcaatccctgagattctttcctctgttttgtctattctgctactaacacttgtgattgcattatgcaattgttgtatttggtttttcagctctatcaggttggttccattcttttccatactggctgttttgtctgttagctcctgtattgttttattgtgattcctagcttccttggattgggtttcaaagtactcttgtatcttaataatttttttcctgtccatattcagaattctacttctgttatttaagccatctcagcccagttcagaacccttgctggagaggtggtgcagttgcttggaagaaagaaggcattctggttttttaaggtttcagagttcttgcattggttctttttcatctctgtgggctgatgtttcttcaatctttaaagttgctaacctctggatggcttttcttttcttttatcctatttgatgaccttgagggtttgattatggtttaaggtgaattcagccactggtttcatttctggaaaagttttaggatccagtgctcagctcctaactcctggactgtgtgctctaactctgaggaatttgtatcaggcctgactttgttctctggcttctcgaggtttgaaattcactgcactggggtggggcaggacgggtagggagaaagtgctgtctgaccactggtcactacactctgatgagtggtgtctgccaaagcatttcatagtgttgcaggaataggatccatttgtgttctcatatgccagcagcagaagcagcaggattgcagagaggtgtactcttgtcagtggtggcagggtgctagtgggtgcctgggtacctgcctctgtgtgggcatttaccacagtggtggaggcatcatggctgagcaaggcagaggggcccccgctagtgactctgtatatattcacgctggtggtggtggtgacacaggggtgaaaggaacaggtctgtgtgtgctctctgtgagccagaggcaggggtggtagctcagggtgggggagggtctgctattctctgtgcctagtttaacttctgcagcagtgttggtgcaagggcagaacactggcaggggcagaacactgtgcctgccaaggctctgactacaatggccatccggcattgggagtggtagcaggccgcactcccactgcagcaatggcagagcagggtgcatgtacacatgcatgctggaggggcaaggaaggtaaaacccacctacccacgcatgcaccagcaaagtgatatggaaggctagtgtgggcctgggaggaggctgcagggtggggagggagggagtgggctggtgtgtggccatgggggctgccctactggagctctccatgggtcaggcatggcccaccagtgcaggagctattatgtggcccccagggcaccctaggttgccctgcaagcaggtacaatgaggctggggtcctgagagaggccagcagacccaggggtgctcaggttggaccaggcccatctgatgggaaagaccgccaggcagagttcaggtctgagagttaccctagggctaaagcctcctatgggagcaagctgaacctagggggagggccatccctggctatgctctgcactagctgctcccacaccaaaccctctgggccccacatcatctggcttgctgttcctaccacttctctaatcagctcttgctgccaactccagtgtccatggtggtcgaggggtttcctcctgctagggttctatgggcccatggagagaggggttgctccttaccagttcagctcacttgcttccctggagtcattgggggccaggaaagagtcccagggcaacgtagccctgtgcagagttctcagcttcctctctcttcagcccagcttctgtggtcttccctccatccactctcagtgccttctctctgaagatctgttaggagtgtgccaatcgtcttggtcccttgtcatggctgttctgcctggctccatctacttggccatcttgtcctctccctgatttcttactatagaaaccttagctcttttttacacttgtttgacagctctcctcttccctctgttatcttttgaactttttcagcttgtctttctattgtcatattcttattttctaggagattatttttgttctcacattgtttcttttaaaattatctcctgtttttgtttcatgcatgtgctgtcctttctcataattctgaagatattatagttgttttttgcttctttttctgtttcttctgcttctgtgcatcgcttgtttcctcagaattgttttactttcttttgacacacagagcctctaattggcttttaaattctcacttttaaatatgcacccaaaattaacagacatttgaggaaagtgtttttatattaaaaaaaaaaagagtagatgaaactacagaacactaaggaaataaattgaagaggacaccaaaaaatggaaagatattccatgttcatggattggaagaatcaatattgttaaaatgtctatatcacctaaaatgatctacagagtcaatgaaatccctattaaaataccaaataaattcttcacagaaataggaaaaaaaatcccaaaatttgtacagaaccacaaaatacctagaataaccaaagctatcctgagaaaaaagaacaaaactggaggaatcacattacctgacttaaaattatactacagatctatagtaaccaaaacagcatggtactggcataaaaacagacatacagaccaatggaatagaatagaaaacccagaaacaaatccacacacctacaatgaactcattttcgacaaaggtgccaagaacatacattaggaaaaagacagtctctgataaatggtgctaggcaaactagatatccatatgaagaaaaatgaaactagacccatatctcttgccatatataaaaatcaaataaaaatggattaaagatttaaattgaggacctcaaactatgaaattactaaaagaaaatactgggaaaactctccaggaattggtctgggcaaaaagttcttgaatactaccccggaaagcacaggcaaccaaagtaaaaatggacaaatgagatcacatcaagttaaaaagcttctgcacagcaaaggaaacaatcaacaaagtgaagagacgacccaaagagtggaacaaaatattttaaaactacctatctgacaagggattaataatcagatgacataaggagctcaaataactctacagaaaaattttaacaattcaaaaatgggcaaaagatttgaatagatatttctcaaaagaaggcaagcaaatggcaaacaagtatatgaaaaggtgctcaacattactccttacagagtgtttttgcatttgcctttgctagtaaccacagagtttcacttctctgagattgttgttattttttgagattcctgcactatttgaatagtgtacatttagacggcacacctatactatgtacaaaattactgttttgatttctcaaacttgagaccttaaaattatttttcacccagatccacaggcagagataagcctcctttacactttcttgggtggttaggacgatatttctccttactttttgtgctgattattaagctacgggccctcaactttaacccctccttccatactctgtcttataatgccaggactgtgattctacaaaacacatttcccctttgccatgtggctgttttttagcttttgccaatagggggctccacatgagggtggaagacaggagagagaaaggacttgccacttcctgtttgtttgctattcctgaagcatcaccctggtgatggtccaccggtccaacaatggcaatggttccagttcttggcttctttacaccatcagtgccagcctcatttcatcccatctccagagacagcagtaccagctgagcagcactccctccttagaggtctgggtcttagttctgtggggaccctcctgcaaggttctcatgactacacacctgggcaagaacacataggtccagaccaataattctgtggtagacagcttctaaaatggccccaaatcatctctgtctctgggtatttatgctcttgtataattcctaccccttgagtgtggctagacctaacaaaaaaataaaatatggcacaactgatgggatgccacttctgagattacgttacagaaagactctggcttccatcttgccctctcttggctcttgcttgctctgagggaaaccggctgccatgttgcaagatgccttatggagaggcccagtggtgagaagccgagggaaggtcctggccaatacctagaaatgaattgaggccctcaggccaacagcttgtgaggaactgaatcctgccaacagccccatgagtaggcttggaagtagattcactcccattggacacctgagtgcagccttgtgagagactctgagtctgatggcccagctaagccacacgaggatgcttcacccacagaaactgtgagataattaatgtttgtggtttaaaactgtgaagttttggaataatttttacacagccctagataacaatacaacctcatttctgataacagaataacttttgaatggaggcagaagatcttcaaaggtgctgactttatgtaaggctggcagttccagctctctctagctcccaccagtctaagacctcgtcacctctcccagcacaggcaataaaaccctggccctgagctgttggggcttttgtctaacatctgtatctccagggcatcatctccctgcaagctccctcctagtttctggcagtacctgaaaatttcccttacttttgaacttaattgtgtacttttaaacattttgtaatatttatccagaatttatctgtgctttaggaagaagtggatgtccccatcagctcagttctccccattgccagaaatccaaaggcaagcagaagtctctggacagtcatacacaggataattaaacccagggagtctctgtattttaattctcagtattgaaatggattgatttttaccagttgttaaaacacagactctagttcataatataaatgatctccctgggtgaatgccactagggcaatcgggtagcttaatttcttcctccctgatgacttacaacttggaacagacaggaaagtagggtatcaaaacaaatacttgaaggccaaagataaaaaatgttaataattagtaacagctagaagcaaagttaattctcagtgggcccataatgccagttatttaatgcaaattaacaaatggcattttaatgtaaaggacttgaaagctaatattctaattttccaagtaagatcaataattcaacaaccaataatgtgttcgaggaaggaataactttatttcagagataagtgaaatgctaagtgaagtttatatttgtggatccaaaattagactaaattagagttaggtgccacatgcattggaaagaaggcctcataaaaatgaaaagtgtgagcattagttgaacacagagtgataaaattttgtgatataatactagataatgagatgctcttatttctttgacagattatgaaggataattctgaattaaagtggtgttgttttgaattcttggatcttgtgttttaaataaaagtttagtcaatgaatcatgaaacagcattccaacttctgaccttgggttgctctggatgaataattttgacttgaagtataaaaacacacccctatattcagactgtaaaattgccgtggccgggaatgacatgattttagcatctagtttatacaaggtgctaaataagaccacatgaagttgataacttccatttgtgtaggaccttgcagtggacaaacacattctcatactttctctcctttgatccttaaaacaagcctgcatggtagatgctcttagcctcatttgataggtgagggaattgagaaattattatttacccgagtcataaaatttgcaaatgaaggattcctccctggacctttgcagtgtgttgctgtatgtggagtgagttttaaaaaattatttgtacaaatttatggggtacatgtgcaattttcccacatgcatagattgtgtagtggtgaagccagggcttttatggtaccaattacccgaataacatacattgtacccgttcactaatttatcatcctctcccctcccaccttctcacccttccaagtttccaggatctattattccactccgtatgtccacgtgaacacattttttagcacctatttaggagtaagaacatgggatatttgtctttttgtgcttggtgccaaataatgacctccagttccaaccatgttgctgcagaagacatgattccattcttttttatggcttttcactccatgatgtgtatttaccatattttctttaatcattcatctgttgatggccttagattgattccatgtctttgctcttgtgactagcattgcaataaacacacgagtgcaggtatctttttaaatataatgatttcttttcttttgggtagatacccagtagtgagattgctgggtcgaatggtagtccaacttttagttctttgagaaacctccgcactgttttccatagaggtgtactaacttacattcccaccagcagtgtatatgagtgacttctactgccatagacactctcttcctcctgctgtgtctgtgcatttgctttccataatggctggcaaagacagatgagtggccccctttatcaccttcactgctgtcaagtgtgtttggtcatgcagctgccctagcacttgtttatagtcttttgttttgaatgtgctatttatcagacagaattcaaatgcaacttcaatcatggtgaactacaaataccttcttttgtggcacattctctaccctcctcccaccctggtattattttcttactctagttaaaaaaagaaaaactttgtattgaagtacaccatgcatacagaaaaactctatgcaataaataaattttcagcaatgcccatatattcagggcccaaagcaagaaaaaagttactagccctccagaaacacccctgtatccctctatcccctctgttaccacccactgtaaaggtaatggttggtctaatttctaatggcctacattagtttggcctatttacatagtttatataaatgaaatctttcctgtctggcttttcttgttcaacaatatgtttgagagactcatccatgtcatagaatgtagttgtacaatgtttgttctcaatgctgcataatattccattgtgtggactctgttattttattaaaatattattacatataaaatataatatacaagacagtagacatatattctagaataatcatatttatccattttatagttgatggacatttgggtggtctcttaaatttggctattattagtagtcctgatctgaacattttagtataggttttttttatgaacttaaatatgtagttttttgtggtaagaatgtctcaatttttgtatcctgacattcttccactggcagaaacaaaaatatataaagagcataatttttccttgatatattttatgttaatgttaataacctaaatcacattttctgtaaagttaagattgctagtaacaaacatgcctcatttgtttaaaatttgtaacaattcagactgaaactcaacagatgtctcttatttagcaaacattttctttaaaaataacatcaattaatattttaatataaagcatattgaccgggcaaggtagctcacgcctgtaatcccagcactttgggaggcagaggtaggtggatcacctgaggtcaggagttggaggccaacctggtcaatatggtgaaacccgtctctactaaaaatacaaaagttaaccaggtgtggtggtgcacacctgtaatcctagctactcaggaggctgaggcaagagaatcgcttgaacctgggagatggaggttgcagtgagcccagattgtgccactgcactccagcctgggtgacacagcgagactccatctcaaaaaaaaaaaaaatatatatatatatctatatatatatgtataatatatatgggatatatttcaaatacaagatctggtcatgaaatgctttagaaactacatttacatatatagctcgcaagataattacaaatggatcttctttaaatatgaaaactaggtatccaaggaagcatcctttataataaacttgttagcagacctgaattggccatacttaaaaatggaaaatttcttttttttttttttttgtttttgagatgcagtctcactctgtcgcccaggctggagtgcagtggcacaatctcggctcatgacaacctccatctcccaggttcaagtgattctgcctcagcctcccaagtagctgggattacaggcatgcaccaccatgcctggctagtttttgtatttttagtagagacagggtttcgccatgttggccaggctgctctcgaactcctgacctcaggtgatctgcctgcctcggcctcccaaagtgctgggatcacaggcgtgagccaccgtgcctggccaaaaacatggacaatttcttttacaagttatgctatattctgttcatttcaaatcatctggatttagatgtggccctggtattaatctagcttgcacagaacactgatctgaacgtagaactttccccccaattaatcaggaagaacacagtagtaaaataatcctcatcatatttaaacattcatggagcagtttgtacaggaagcatggcgttggctggaaaggactgtggtcggggaaagtatgtgtgaccagggcatgcacgtcctctctcctccctccacccagtgcttctgcagacttataaacatggatttataaatatgtcattccaaacccttttctcactaagcatcccctccccctttgtttattatctagccctgtggcttaggagagttctgttttgactaagccagcgtctcttttcaaaataattctctcaccgcctcctaaaaataaagtttttccctctgctacacaatgaattggaagagtcgggtgccctggaagcccaggagaagagcattagcacagctctgggaggtggggggatagaggagagagggcctcaagatgcttccaggggaggtgagctttagatggagaacctgagcatgagtactggtgccgtgggggtggggtttgggttagcctgtgtgtttgggtcagaatgagctgtgtgtgggaaagagcagggtcctttccacgagccagtggccctctcctcacagcagtgtacatgagcgttggttgcccacgtagctgacattgttggagaggtggctctgtgagatatatatttagtaaaattaatcatattctgataaactcttgtgtataatccaggaatgcaaatcttagaggtggcacagcagtggggagaaggccagctgtgagtccacactcttaagtatgaaacctgggttgtcacatcctagatgtgtggtcctgggaagggtaggtatattcttcttcacctgtaaaatgggaataaaaataacacacatctcagagaatcatcctgaaggtgatactgaaattacacatgcaaaaagctgtgcacagtgcctggtccacagttagcacccagcaaattggtaattaagtaattaatcaattaacggtaaaactcttaattgcactttattaagtttttctctggaagttcttcagagaattgattattgagaacaacactgatgtccctcagtcagttcaggctatcacagaataccagactggatgacttcaataacaaacatttctttctcatagttctgggggctggaaatctaagatcagggtgccagcatggttaggttctggtgagaaccttcttcctggttatgtcctcctctggccttctttggtgtgggtggagagagagagagacagatggagagagagaaagagagagagagagagagagagagagagatcctgtgtctttttgtaaggttatgtcatctcaccttcatgacttaatctaaccctaattgcctcccaaagggcccacctccaaatattatcccattggagactctggtttcaacatagaaatttagcggcgggggaagggcaggggtggggggtacggggcggacacaaatattctgtctgtagcaaacaacaacatttataaagtacattaaaattcataaaatgctttcatataccttctttgagccacataataatctaggcagaaaatagggatgaggaaattgaggttcagaaatgttaaatgtttcagccaacaaagctcacagatggaatccatctccggctggaatagaaccatgctgcagatgctcagactggaagtttacagtcaggccccagagatgccctttcgaactttacctttcaaattccccacagaagagcatgaggcaaactgggctcatacccgactgcctcctgagcgtgtcagaagatcaaaggagatagcgtgtggagaatctctttctgtagtgtagtatgccatgtttttagctgtttttagttgtagtcctcttttgtttagtagcagcttagcctaccaatgtgatatagctcaggcagcaatttttaactccttaaagttttgccaagaaaatttgaagtttcatatgaaaaggcagacattattaatagcatgtcaacaaatatttggaatgagtggtttttctggcttcccgtgccagaaaaaccacttgcttgatttcaccgtaacaagtgtttaccatagtgatttcacgtcatgtcattttaggttgggatcaggattggtccaattaaaacttcacatcttaaaggaaggtttcctttctttcccgaattactgatgaagaaagtttttgtgtgtgcatgcatgcaaggatatgcacatatgtgtgcaaacgtgtggtggagcatgggaataaagagattatagaagaagagaggtgtttcaccttttcagatattctgtgctcgatcttttcagctctctggtctttctgatacaagcttcctctttccatcaaatgcttgacgggaagcggaatcttctggattcagaataccggctgttccctccctgtgccctgatatgtctgaaggacacacttttctgtggctttacctgttcttctcaaaggggtaaaatagctgagccctcctttccacgtcactgaattctaaccttcctgccaatggaagctccaatcctgcctgctctgtctcaccccctctatccaccagagctagaaaggattttttctccctaatgaagcctgtgatttcctagtggcccttagctgccagcataggcagtctgcattgtatttttgtttatttgttattttagagacagagtcttgttctgtcatccaggctgcagtgcaacagtgcaatcagaactcctgggctcaagtgatcctcctgccttagcctcctgagtagctaggactacagtcatgcaccatcatgcccagctaattacaaatatatatattttatagagtcagggtctcactaagtcacccaggctggtctggaactcctggcttcaagtgatcctcccaccttggcctcccaaagaacttggattataggtgtgagccatgacagctgatctgcattgtgttttagataataatagtcacatcagccagcttgtattgaggacttgcactgtgccaagctccgtcctacgtgccttactcaaaatagctcatttaactctgaaaataagtagacaacaatttgtagacggcaaagggactattttttgctccctagcaatattttgaaggatactgagacttagtatgttttttggggtggtggatggggagtgatgaggtgaaccttggatgtgataggaacagaataatttaccaggagaaaaccttccacatctttgccatcccttttcctccccaattttttattataactttgttcaaatgtacacaaatatgggataatagtatgataaataactaaattttaagcctaacaatttttagtattacacatgtggaatttatacatatatgtatgttataaatgtgttttttgtggaatcattcaaaaatgaattgctgatatcatcacattcatccctagaaagtacagcatgcatcagcctcttacgtggccatgatactgttatcacacctaggaaggttaacaataaaattggatgtggattgtctttgtctcttcatccctatttgatcagtaaaaaggcaatagaacaaaacaattaaaatttggatttctaacaatctagcattccacattctttggttacctgtacatggtatagtcaatctttctatttgcttggaaagcacttgctactttgatgtgggagagatactatcttttactactttgaaaatttgatttcaccttcttaatatggtaaatatggacatgcccatggcatgattgggaaaattaagaatgaacattatagattaaaaatttcagcccctatagattggaactctagattttttccccccaaaaatccagttaaatttagggataatcaataattcatagatacaacctctaaccaaggatttaacagtttaatgaacaagaaaccatacattagtccaaaatttaacagttaatagataagacttcaacctccatttctaagagtgtgcaccagctggggattcagttacatttgtgagctggtgacagattatggctttttccatttacgaaagaaatcactgtttttgctgactctagaaaaaatataacttttaaaatattgaagaaataggccaggtgcagtggctcatgcctgtgatcccagcacttcgggaggccaaggcaggcggatcacctgaggttgggagttcgagactagcctgaccaacatggagaaacctcatctctactaaaaatacaaaattagccgggcatggtggcacatgcctgtaatgccagttacttgggaggctgaggcaggagaatcgcttgaacctgggaggtgaaggttgcagtgagccgagatcactccattgcactccagcctgggcaacaagggcgaaacaccatctcaaaaaaaaaaaaaaaaaaaaattgaagaaataatgtgtaaactttgcttcatatttatttcctccaagccaactagtatctcaagacttttcatactggatatagttgtctaaacacagtatattatcttccaagtattcaattatacttgattaatttgcctgaaaagtttttactgtgaatggcatttgtgattaatctgacaataatgattgatattagcttgtctctgacagagacaatgtttgcttcttcctttccaggtttggaactatgcttggtcgttcctagtacttgtggaaagaggtaagtgttatatgataccttagaagtgaatatccaagtaaccaagaaatattcaatgatcatattgtgctgacctgggaggaaatcctagtttttgcttttgataagagcctgtacttttcatggtggcatgaattgttccagaaagacataatggtccttgctaagaagcttctgaaacttctgaattttagggaataccaactgtgtgtcaagtgtacttaaaatatctgatatgacacctttctaaaatgaaatcaagcttttatgagttgaattgtgtccctgccaaaagtatgttaaagtcctaacccccagaaccttagaatgtgaccttatttggagatagtgtcttttcagatcaagttaaaataagtcgttagggagggccttaatccagtatgactggtttctttataaaaaggggaaatttagacacagaaatcaggatggtgtttctctaggctaaggaacacaaagagttccagcaaaccacccaagactaagggagaggcctagaacagattcttcctcacagcctcggaagggaccaaccctgccaacgctttgatctcggacttctagcttccagaactgtgagccaatttccattgtttaagcctcgcagttgtggtgctttgttatggcagccctagcaaatgaacacctaggtcaactacttgagctcatgtatgcggatgtgaggtgtaatagtttctcagtggctgggttgcaactaatattagtatacaatttcctctggggaattaagtagtgttctttatatttacttaagatgctctttttcttatattcctacaaagtaaaattattttattttaaagcgaatcatgtggatatccacatacgtaactaattagctattcattgaccattgaaatattagtaatgatgatatcattctccttggggtagggaagctgaatgttttagtctgctccacatctccttatctgggaaacattcctgagctactgtctagtccctactctgtccttgtggtatggttaaaactatgtattctagctggtcccagggatagccaataaaacttatccatgtctctggtcactgtaattggttcagcaatgagaatatgacccaaggtagaccaatcagagggtttcccaggcattttgctggcatgatcaggaaaaatgttatttttatcaataattaaaagtcctaaggtcagtgtagacttctcttttaggatgggatcctcactgaaaatgatggagccaagctgggtcaggaggaatagggtcagtcagaattcttaatccatgaatcaaacccttcctgaaatcagaaacattccttggactttccacttatacaaaccaataacttttctcttgtgctttaagccactttgagttgggcacttacaaggaaaagtgttttaatgcatctgtgatgtgtaatctttacttattttttgcccctttacatcctctgaaagccttggattattccagtgtttggagcacagtacattaagagttggttgaattttttatcctacattgtcagaataaaattaatttccaaattaaacaaaatgacactgtgatgattttccctgtaatatgcaatgatgtcaagcactattcactattgtcactgtggcaggtgagttttccagtgatggccacatgtgtagtatgtacatatatcccctcatatgctcttatttcaatgcaattgtctatcttcccacagagaagtcatgtctgtgtttcttccctatgaatgtgagacttgtgactgctccaatcatgagaaaatggtggaagtgacagtacgtgaccaaagcttaaagggtacaacctccctttatatggacctggccctctctcagatgtttacccttggaaccacttgcagctctgtgaggacaaacaaggagaagtccacatgaagaggagctgggctcctagactccactagcatcacctaccagacaagtgagtgaacaagccttcagatcacttctgcccccagtgttcaaggtcctagatatcgcggagcagagatgagtcatggtcacaccgcgttatttcagtttctaaacccctgaatatatgagcataacaaatagctttacatcactgttagggtaatttttatgcagccatcctgagatcattcatttgtaatgtgttgtgctggctagactgaactacgtttctcagaattcccttatgttttggtcagggcaggcctcaggagagagtcttatgggagatttggaaggtggaagtaaagtggcagcttttttgtattttttaagctcacatgcatggttgctggcccattggctggctggcattaggcagcaacctgaccggcagcctgtagctctcctgcactagtgtgtgcttagctccctgacaaaggcctaaacttcttcaggactcctgcatcataaaccttagaagcaataaaaactgatatgttatgagatccagtttgtcctctgggtaccaccttgcccatgcccctcttctagtttataaccatcttctcttcctgcttgcctgccttgtagacctcaagcatcgtcatcagactccaggacaacagctttgcagatgccacttaaccagctcctgcaactatgtaaggtcaaatccctgtttataggagagagaggcagaggaacatggccaaacagaagctcactgattgtcctccctgtaggaacaccaaattgaacaactatccacacagaaagcacctttataagaaccaaaaaatcaggtgattactgtaaaaggcactaaagagggtaggaaaggcagtcttaaattgctgattccaccccttccccatcctccagcagtgaccttgtggcatggagaatctgtgcatttagggtaagaagagtgtagtgatcatgagactgtgttggaatactcagtgcttccctgtcagagagcaacatctggaagaattcaactggtgcccatgaaagaaacatttagaccagctcaaaccagagggtaatagcccaatctgaattcagggaagactcatcactgtgggctaaagtgctctcgggtcgtaaataaacttgaaacacagtctaggccacaaggactgcaattgctgggcaagtcctgctgctgtgctgggctcaaagccagtggacctgggggacacgtgagccagtgagatagtgaatggagtgcttacatcacctttaatccaattccagccatcacagctcaaaactccagaagagattccttccctccacttgaggagagaaaagagaaaagaggattttgtcttgaaacttggataccagctcatccacagtaggatagggtacaaggtacagtaggatagagtcctgaggtccctattccaggacctggctcctgggtgacatctctggacacactctgggccagaagagaatccactgccttgaaggacaggacccagtcttggcaggatttatcacctgctaactgaagagcccttgcgccctgaataaccagtggcaatactcaggtactatgtcgaggaccttggttgagttgctgagacttgctcacttcaggtgagactcagcatattcccagttggggtggctatggggtgaaactcttgcttgactgagaaaaggagagggaaaaatacagggggctctgtcttgcaccttaggtaccagctcggctacagtggtttagatcaccaagtgggttcttggggtccctgattccaggacttgacttttggataacatttctggacatgcctggggccaatggggaggccactgccctgaagggtgagccccaagccaggcagcattcaccacaagttgatttaagagcccttgggccttacaggaacatcagtgataatctggcaatactccctgtggcttgtggtggtggtggctacagggtgaggctcctctgcctttggaaagtggagggaagaaggactgcatcttgtgttttgggtgccagctcagctgcagtacgatagaatgccacgtagacttctaaagattctgactcaagacactggctcctggatggcatctctggatctacccagccctgggggatctagctgccctgaaaagaacgacacaagcctagctggctttgccacctgctgattgtagagacctagggccttgagtgaacataggaggtagccaggcaatggataccacaggccttgggtgagacccagtaccatgctgtcttcagatgtgaaccagtgcagtctcagtggtggtggccatgggggtgcttgtgtcatccctcccccagccccaggcagttcagcacagaaagagagagactctgtttgtttgggagaaagtaaggggagagaacaagagtctctgcctggtaatccagagaattcttccagatcttatccaagtcaccaagacagcacctctatgagtctgcaagagccacagcattactgggtgtgggatgcctcctaatgcaaatagggctgcaatgaccaaaaaatagatttaaacacccaagtcacttcaaatatctggaatgccttcccaagaaggacaggtacgaataagcccagactgcaaagactacaataaatacttaactcttcaatgtccagacaccagtgaacacccacaagtatcaagactatccaggaaaacatgacctcaccaaatgaactaaatacttgccaggaaccaatctcagagagacagatatctgacctttcaaacagagaatttaaaatagttgttttgaggaaacgcaaagaaattcaagacagcacagggaaggaattcggaattctattacattaaatttaataaagagatggaaataattaagaagaatcaaggagaaattctggagttgagaagtgcaattgcaacactgaagactgcatcacaggctttcagaagtggaattgatcaagtagaagaaaaactgagtaagcttgaaggcaggctacttgaaaatacacagtcagagaagacaaaagaaaagagaatttaaaaaataaagcatgccaacaagatttagaaaataggctcaaaggggcaaatctgagttttggcctgaaagaggaggtacagagagagataggggtagaaactttattcaaagggataataacggagaactccccaaacttagagaaagatatcaatattcaagtgcaaggcggttatagaacaccaagcaggtttaacccaaagaagactcactcaagacacttaataatcaaactcccggaggtcaaggataaaggatcctaaaagcatcaagggaaaagaaataaataacatataatttagctctaatatgtctggtagcagacttttcagtggaaacctgacaggccaggagagagtgacacaacacatttaaagtgctgaaggaaaaaacctttaaccttagaatagcatatctggcaaaaaaaaaaaaaaaaaaaaatccctcaaacgtgaaggagaaataaagactttcccagacaaacaaaagctgaggtatttcatcaacaccagacctgtcctacaaaaaatgctatggagagttcttcaattagaaagaaaagaacattaatgagcaacatgaaatcatctgaaggtgtaaaactcactggtaatagtaagtacacagaaaaacacagaatattctaacattgtaattggggtgtgtaaaccacttatatcttgagtagaaagactcaaagaactgataaaaaataataactaccacaacttttcaagacatagtacaataagatataaatagaaacaacaaaaagttaaaaagtggagggacaaagttaaagtgtagagtttttattagttttctccttgcttgtttgttagtttctttgcttatgaggtcagtgttaaattgtcctcagcttaaaataatgagttataagatattatttgtaagcattatggtaacttcaaataaaaaatagacaacagatataccaaaaataaaagcaaggaattaaaacataccaccaggaaaaatcaccttcactaaaaggaaggatagaaggaagagaagaccacaaaacaaccagaaaacaacaaaatggcaggaataagtccttacttatcaataataacactaaatgtgaaaggactaaactctccaatcaaaatacaaggtagctgaatggattaaaaaaaaaagacccaatgatctattgcctacaagaagcacacttcacctataaagacacaaatagactgaaaataaagggatgaaaaagatattccatgctaatggaaaccaagaaaatagttaaagaggagtagctatatttataacagatgaaatagatttcaagggaaaaaaagacaaagaaggtcattatacagtaataaaggagtcaattcagctagtggatgtaacaactataaatatatatatgtactcagcactgaagcactcagatatataaagcaaatattattagaactaaggagataaaccccaataaaataataactggagacttcaacaccctttcagcattggattgatcctccagacagaaaatcaacaaagaaacattagacttaatctgcactatagaccaaatgaacctaataggtatttacagaacatttcatccaacggttgcagtatacactttcttctcctcaccacttggatcattcacaaggttaggccactgtattagtccattttcacactgctgataaaggcataactgagactaggcaatttacaaaagagtttattggacttacatttccacatggctagggaggcctgtcaatcatggtggaaggcaaggaggagcaagtcacatcttacatggatggaagcaagcaaagagagagcttgtgcagaaaaactcctgcttttaaaaccgtcagatctcatgagacctattcactatcatgagaacagcactggaaagacctacctccataattcaatgatctcccactgggtccttcccacaacacgtgggaattatgggagctacaagatgagatttgggtggggacacagagcaaaatcatatcattccactcttggaccctcccaaatctcatatcttcacatttcaaaacgaatcatgcccttccaacagtccctcaaagtcttaactcatttcagcattaactcaaaagtccacagtacaaagtctcatccaagacaaggcatgttctttctgcatgtgagcctgtaaaatcaaaagcaaattagttacttcctagacacaatgtgggtataggcattgggtaaatactgccattccaaatgagagaaatcagccaaaacaaagggattacaggccctattcaagtccaaaatccagtgaggcagtcaaatcttaaagcttcaaaatgatctcctttgactccatgtctcatatctagttcacactgatgcaagaggtaggttcccatggtcttgggcagctccgcccctgtggctctgcaggatacacctccctcccagctgctttcatgggctggtgttgagtgtctgtggcttttccaggcaaacagtgcaagctgttagtggatctaccattctggggtctggaggatggtggtcctcttctcacagctccactaagcagtgccccagtagagactctgcgtggggactctgaccccacatttcccttccacattgccctagcagagtttatccatgagggcctcacccctgcagcaaacttctccctgggcatccaggcatttccatacatcttctgaaatttaggcagaggttcccaaaccccaagttttggcttctgtgcacttgcaggctcaacaccacatggaagctgccaaggcttggggcttgcactctctgaagccatggcccaagctgtacgttggcccctttcagccatggctggagcaactaggacacagggcagcaagtccctaggctgcacaaagctcggggaccctgggcccagcccacgaaaccattttcttctaggcctctgagcctgtgatgggaggggctgatgtaaagacctctgacatgccctggagacattttccccattgtcttagggattaacacgtggctcctgttacttatgcaaatttctgcagcctgcttgaatttctcagaaaatgggtttttcatttctatcacattgtcaagctgcaaatcttctgaacttttatgctctgcttcccttataaaactgaatgctgttaacagcacccaagtcacctcttgaacgctttgctgcttagaaatttcttctgcaagataccctaaatcatctctctcaagttcaaagttccacagatttctagggcaggagcaaaatgctgccagtctctttgctaaaacataataagaatcacctttgctccatttcccaacaagttcctcatctcatctgagaccacctcagcctggaccttattgtccacattactatcaggtttttggtcagagccattcaacaagtctctaggaagttccaaactctcccatattttcctctcttcttctgagacctccaaactcttccaacctctgcctgttaccaagttccaaagttgcttccatattttcagttaccttttcagcaatgtcctactctactggtaccaatttagtgtattagcccattttcacactgctgataaagacatacctgatactgggcaatttgcaaaagaaagaggtttattggacttacagttccacatggctgggcatgcctcacaatcatggcagaaggcaaggaggagcaagtcacatcttatgtggatggcagcaggcaaagagagagcatgtacagaaaaactcctggctttaaaaccatcagatctcatgagacccattcactatcatgagaacagaactggaaaggtccacctccataattcaatcatctcccccgggtccctcccacaatacatgggaattatgggagctacaagatgagattttggtggggacacagagccaaaccatatcagccacaaaacaggtcttaaaacattcaaacaaatcaaagttacatcagacatcttctcagacaatggaataaaattgtctgacaattctcagacaatggaataaaactagaaattactaagaaaagaaattttggaaactatacaaacacatggaaattaaacactgtactgctgaatgaccagtatgtcaatgaataaactagaaggaaatcgaaaaaattttcttgaaacaaatgttaatgggaacacaatataccaaaacctatgggataaggcaaaagcagtagtaagaggaaagtttataggtataagcacttacatcaaaaagtagaaatactttaaataatcaacctaataatgcatctttaagaactagaaaagcaagagcaaaccaaacccaaaattagtagaagaaataataaagattaaagcaggaataaatgaaatgaagaaaatacaaaagatcaattaaataaaaagttggttgtgaaaacataaacaaaatggacaaaactttagccagactaagaaaaatggagagaagacccaataaataaaatcagagaagaaaagggagacacttcaactgatactgcagaaactccaggattattagaagctagtatgagcaactatatggcaataaattggaaaacctacaagaagtagataaattcctagacacataaaatctcccaagattaaactatgaagaaatccaaaacgtgaacagaccaataacaaataacaagatttaagctgtaatacaaattctaccagcaaagaaaagcctgggatgtgatggcttcactgctgaattttatcaacatttaaaaaagaactaataagaatcctactcaaactatttcacaaaatagagggaacactttccaactcattctatgaggccagtattaccctgataccaaaaccagaaaaagacacataaaaaaagaaaactacagaccaatatccccaatgaacattgatgcaaaaatcctctacaaaatactagcaaactgagttcaacaacacatttaaaagatcattcatcatgaccaagtggggtttattccaaggaagcaaggatggttcaacatatgcaaatcaatgtgatacatcatatcaacagaatgaaggacaaaaaccatataattatttcaattgatcctgaaaaaacatttcataaaatttaacacccctttgcaataaaaaaccctgtgagggaacatgtgtcaacacagtaaaggccatatatgaccacatatgacagacccacagctagtatcatattaaatggggaagaactgaaagccttttccctaagatctggagcatgacaaggatgaccactttcaccactgttatttgacatagtactggaaatccaaactagagtgattagataagagaaagaaataaagggcatccaaattggaaaggaaggagtgaaattatccttgtttgcagatgatatgacacttggaaaaacttaaagactccaccaaaaactgttagaactgataaaacaaatttggtaaaatttcaggatacaaaatcaacatacaaaaatcagtagtatttttatatgccaacagcaaacggtctgagaaagaaatcaagaaagtaatctcatttataccatttataatagctacaaataaaacacttgaaaattaccttaaagaaagatgtgaaagatctctacaataaaaagtataaaacattgatgaaaggaattgaagaggacacaaaaaaagaaagatattctacattcatgaattggaagaatcaatattgttaaaatgtccatactgcctgaagcaatctacagattcaatgtaatccctttaaaaataccccattcttcacagaaatagaaaaaacaattctaaaattcctaaaatttatattgaacacaaaagacccagaataatcaaagctatcctgagaaaaaaagaacaaaactggaggaatcacattacctgactccaaattatactacaaaatctgtagtaaccaaaacagcatggtcctagcataaaaacaaacacatataccaatgaaacagaatagagcacccagaaataaatgcataaatctacaatgaactcatttttgacaaaggtgccaagaacataccttggggaaaagacaatcttttcaataaatggtgctgggaaaactgtatatccatatgcagaagaatgaaactagacccctgtctctcaccatatataaaaatcaaatcaaaatggattaaagacttaaatctaagacctcacaccatgaaactattgaaagaaaactctcggccaggcgcggtggctcacgcctgtaatcccagcactttgggaggccgaggtgggcggatcatgaggtcaggagatcgagaccatcctggctaacatggtgaaaccccgtctctactaaaaatacaaaaaaattagcctggcgtggtggcagacgcctgtagtcctagccactcaggaggctgaggcaggagaatggagtgaacccaggaggcagagcttgcagtgagccgagattgtgccactgaactccagcctgggcgacagagcgagactccgtctcaaaaacaaaaaaaaaaagaaaactctcccagacattgaacaaggcaaacatttcttgagtaatatcccataagcccaggcaatcaaaggaaaaaatggacaaatgaggatcatatcaagttaaaaggcttctgcacagcaaacagcaaagtgaagagacaacccacagaataggggaaaatgtttgcaaactatccacccgacaaggaattaataaccagaatacataagaagttcaaataacgctataggaaaaaagctaataatctaatttaaaaatagtcaaaggatctaaataggcatttctcaaaagaagacatataaatggcaaacagatatatgaaaaggtactaaacatcactgatcattaagaaatgcaaatcaaactacaatgaaatatcatctcacctcggttaaaatggctttttatctaaaagataggcaataacaaatgctggcaagaatgtggagacaagtgaacccttgtgcagtgttggtgggactgttaattactattaagactacttactaccaattagttacttttgtgggtacaacaactatggagaacagtttgaaggttcctgaaaaaactaaaaattgagtactatatgatccagcaatcccactgctgggtatatacccaaaggtaagaaaatcagtatattaaagagatttctgcactcctctgttaagcagcactgctcaaaatagccaagatttggaagcaatctaaatgtccatcagcagacaaatggataaaaaaaaatgtggtacatatacacaatgggagtactattcagtcataaaaaagaatgagatcctgttatttgcaacaacatggatggaactggggattgttatgttgtgaaatatgccaggcacagaactttgcatgttttcacttctttgtgggagctaaaaattaaagcagttgactcatggaggtagagtagaacaatggctaccagaagtggagcacgaaaagggggacgattaatgtgtacagagatatagttagatagaatgaataagacctagtatttgataacacagcagggtgactacagtcagcaataatttattgtacatttaaaaataactaaaaaagtataactggatttttataacacaaagaaaggataaatgtttgaggtgatggatactccacttaccctaatgtgattattatgcattgtatgcctgtatcaaaatatctcatgaccccataactacatacacctgctatggtacccaagaaaatgaaaaattttaaaaaccctctttatattatatataatgcctaatatataatattcaattataaactatactgcaatatataatttaaaatatatatgacaagatactatatataatatgtaacatataatagatgtcctcacatacatattatatacatgtatgtatgcctatatatctcctggattctgcttctttgattgaaccctgattgatacacatagtaattggatacacatagtattcaataaatggctttcttctgtttcattttattcccctcttgtcactcaatattgcacagccacttgcttctggttattgctcacagcatcctgcacttgttccctgtttacatgagtactgccgcaatcctcactaatttgcaagtctgaaagcattttgatgacgtaaataacctttgaatgcaagctgtgtctgagaaaaactttcccacgtatataagaatagatttatatccacattggactcaaatatccacatgaagataaaggcttccttcttcctcatttcctggatgactcttcatccaactttttaggtcaaggcgtcttagtctgctcaggctgctattacaaaatactataaactcgtgacttaatcaacagatgtttatttcttaccttttggaagccagaagtctagcaccagggtgccagcatggtcagtgtctgttgagggccctcttcctggctttcagagagctgccttcttactgcgtcctcgcatgatggagacagcgttctggtctcctattattaggacactaagcccatcatgggagccctaccctcatgacctcatctaaacctaattacctcccaaagatccccctccaaatgtcatcacaatagggtttaaggcttcattatatgagtttaaggggggcacaaacattcagtttataacacaaggtaagaaataaatccaattaacctataaagacttctgaaggatttaagtatttgctcattgttggctgtgtttggaagttggctgctgaaaggtatactctgcacacgagacatatattgggagggtatacttgaggaagatggtctccagttcctctacagtgttaaggctgatgtatgtcactcctacaccagtatttaattgtacattgtccccatcatatgctaattgtgaagcttcctcagcaaagagaaaaccactgcagccagggacactggtggagaatatgctgatgactcagagtgaagcatggcaactcttagaaaaatgacaactgtattctctgctagtggaggtaccctcaaagagaaatgtcctgtacagcccaatatattacattgttagtcttagatgtagtgagatgcatcaacatactaggaatataaagcaagtaggtagaattactgttttcactccaggatcaggaaaggcatctaagcatcaaacacactgggataaattgcatatggcagtatgtctcctggctctgagcgatgccccttcctcctgctcacacaaacctccttggccacagttggttggactgagtattgacacgtgacccatgttgggccaggtagattctttttcctgcgaacttggattttcatcaagaaatactatgtgttacttaaatggcaacatatcaacatggcatatcagaattatttcaggtgcaagtggctgacatccagtctaagtggcttaaacagaagaggatttattgactccatgactgaaaagtctaaaggtaaaactcagtggaggtttagattgatccaaagatctaaaaattgcaacaggactaaggttctttttccatttcccgactgtttcttctgggttggtgcaatctcagattgtggtgtcaagaaggctacagaagctccagtttacaactcccaagtttgagtccaaggggaagagcgcatccttcattacccaaagtcctagcaagagtctctttgcatctcactgactctgattgaatcacatgtctatagccgaaccactccccataggtgggaaaatgtgatgctctgacggtcgctcacccagagctagaggtaaaagtcaagcatttagaaaaatagggaaagcaaaagtaagagacaatctcaagctaccaaatgttcattacctcaatgtctggagctatgaggcagccatgttccaccatgcagacagagaagcagaggaagcactggctaaaacgagagaaaagactggcatagacattatagggtccaaggggtaggtttccctcagccccttgaaggttcactgaaaaattaattcacaaaagaaagatgaataggagaaaaggcatatatattgacttaatgtgtgtacacgggagccttgagaatgaggccccctttaggagaagctgtccatttttatgtttaggtacaacaaagtatggacagccatgtagaaatacgattggagaaaaagggtgtgacctaatgctaatagactgagtgggaaaacccaacaaagcctatctgactagattcttcttggcctctctgagcactgttccttccttctggggatggggcaggaccttctctgcaataggcatcttatgatctacagtcagacaaggtaggtccgataattttctttatggccagtttttattcagaacgggaaagggaaagctagcgtaataattttaggttttatggatagctttcaggaaaggaggctgtggtttctacggtttgccttggggaagagggattctagtttccatggctagcctcaggggaaattgagtctgagagacagggtggtaggaggtcagagaaaaactttgcttctaaggccttcatgttggggtattgttttctgagccccaaagccatgcagaaggaacaagagacagaaaacagaaagggcacttcccaggtccctgtggttttacagggcatgtttccatctcttcctgaggcttgatgcaaacctgttcttaggatctgtgagactcctctgtggcttgatagtatgtcctcttttcctctctttttcttttgttcctctgaaggtaacttgcattggtttctattactcacaggcagtgacattaatcctaggagcccatcagagtctttacatagctctgtgacgggaaaacaaatggagcatatcccaggcctaggaattgtctgtcttggaaggaaaagtaacaaaactgtgtgccagaatgtgagagagaatgctggacatttgttgtttttcccatcaacatcttctccttgccccatggggtatcattgctccacaattctccagggatgcattgtgggtaaaactgactccatgtttaagccaatcagcacgttccatacatctgccagagtgactgacttcctaatggtcagatgatatgaatcctgcccatgacagctaagaagtttcagttctcatgcttttgttggaactgtcagtgaaacatattctcctttcctgttggtatgaatgtgaaaggatcacgggactggaattatggaagatagtttgtcaacacatgagtcctgtgcatgaactgaacaccaggaaagcatagttgagaaatttagacaggagctccagcccagggaagtcatttgagccctggatcaagctgtacctgaaactggagctccctctggattctttagttttgtgagttaataaattcttttttcttttcttaatctgatttgagttagagttttgtcacttgcagcagaaggaatcataactaatacagttatgggaagttatgtttgaggaaaggtgtcaggtaatctataagatggagaggctgaactataaacagagcaggtcctaaaactccagtaggcacgctttctccttttcttgaaatcataaaacactacaattgacatggcatatatcacacattgccttgaactgcaattacagttcttgtatggtaggtacaaatttcacaaccataaaactccggtgtgcagaaatgtaactttctttattgttttataattgagcttaatttagctcacaaaccctcatttctgctaatggtagggaacttaatcttgccaattccaggcaattctgtcagtcctggtttaaagctctgtatctttcaattactttaggattccaagttcctctactcctttctttttccctaaggtgatctgtgttctagcaaacatggcaaggaggcaaatgtctggtctgggagttgacctcgggccagtgggcaacaggctgtaattggtccaggagagctgggcactcatccttgttggctctgtccccacccagttcttagctcagcttctgcagattcagccatgactttgtctagttcctagtttgggctgcccacatagtccctggccttacatcatggtcacctccctaccaggcacaccagccctcaattctcagctccctttggcattcgaatccaacgtttggggacttctgggtttccacatcctgcaggagtgagggtgttgggaggatgggtcctctcggcatcctgtctgcctgaatcatctctgctcccatttctgcattataggaaccaactgtgatggttaattttatgtggcaacttgattgggccaagggacgtccagatatctcaccaaacattctttctccacagtctgtgagggtgtttccggaagagattagcatctgaattggtggactgagtcaagcagatggccctctccaatgtgggtgcaggccacccaatctgttgcaggcctgagtagaataaaaaggtagaggaagggagggttctttctctgtgtcttcttctgactgcttgaactgggactttgatcttccatcctcagcactcgtggttctcagccttcagacttgaaatggaaatcacagcaccagctctgcgcttctcaggccttgacctataccattgactcctgggtctctagctgtaggtggcatataatgggacttctcagtctccacgattgaatgagtcaatactgtattatctatctatctatctatctatctatctatctatctatctatctatctatctatctatctatctgtcagtcatctctgtgtgtgtatatcccctatctgtttctctggagggcctgcctaatataatacaccaccatatgtggctcaggaggcagcttcctcctggatattcaggaaaatcagttctgctcttggaccctcaagccctcaaacctgctgggtgtgatctcaagggagggtgcaggcctccccctcctctcaccttgcttgcttccctcctgtgagatctgcagctcccacccaggagggctattgtcctcaccatgtgccgtggtttgttgagctctttgctctgggaccctcctggctggctcttgatgtttcttgaaatacaacaaaagatctttttcctctcacctgtctggattttataaatgaaaatcatggtctttaagaccatgcctccaagaccaattaagaccatgtctcaattgccagaaattcactccaaaggtccaagttccagagtttaaatacatgtactggcttcctcattgggtcagctcttccctgctgccacaggcctcagacttgcggttttgctttagtggaggaagcactgcagggcagagacaaggaaaagagttccagagaaggaaagccacttggtactatttcacaacaggatctggctcagtgagccacagctactcctccaaccacagaagcgcctccagtcttgctccccatgtgggatggccattgctgtggggtttgcaggttgcttgacacctttgtggagccaaactccaccagcgctactgagaagtgcagctagtagaaggaactgtcccttccagcttaactatcctttttttaaggccagttggccccaggtggtcattgttcttttagcctctgaaagttggcctcagtgttttatttcagtagcttcttgtcaataaaccaacactgagttccctgcagtgttggcctaggctgtggtggcccctgtgggactcctaactcatcctcagtgctgtgagttgaatggtctgccataaagatgtgttgaaattctagcccctggtggcagtgaatgtgaccttgtttggaaacggtctttgcagatgtgattagttaaggatcaagatgagatcttgctggattagggtgttgcctgaacttaatgactggtgtccttataaaaaaaggagaggacacacagagacccagactcacagggagaaagccacacaatgatggaggcagagctggcagtgaggcatctaccggccaagggacaccagggactgctgggagctgccaggagctggaagaagcagggaggatccttccctggggactttggaggagtgtggctctgctgacactttgactttggacttctgacctccagaactaacagagaataggtttctcttgttttaaacagaaatgtttgcttctttagtgcgactttgttccagcagccctaggaaacactcaggaacctcaatcatgacccatttctctgcactcagtcctaggttcagacactctaaaggcttgagacattgcagggatccagaggctgctaaatagagagtggacccctcctaggtcccctttcctgggctggtgtccccagctgttgtgagtctgggctgctgacagctcagacggctgtcctctttaagaagtttcccctgtggaacaagagctgcctcacccaggaggcttcacagcacccctagtggggtgggcagcccacagtcaatgactggttggcatgggacaaaggctgctctccttgtgcaaatggggtgcagttccttgttcctgagctctctgtggggtcaggctgagggtcctggctaccccctcccttccagtgggtacagtgctccatcctctctgtgcctccgaggcctggctcaggtttggcctctagcgaagctgacctatcaccatcagattggaactccctgagggtagggcctatgtgcttagtggccctctcctttgctgggtaaggtgtggcctaaggcagggattcttaatctttaatgtgcatgtggagagcttatttaaacgcctcttcctgggcctaactccagaagagtctggtcccgagaactggcatttctaatcagctcccaggtgctgctgctgcattttgagacttactggcctaagctctgtggattaatgggatcttgtcgggtcggggcaggcctggtgaccgagaggacaagcacaccagaggtccacagacatttgtttgcatgtgggatttttgaggctgggcagagaatgtaaggagtgtgtgtgcagggttgggagttggtaggagatgaagaatctgttgtggtgttttcaaaggtggattcctgggcccagtcccctggcctgtgtctaagctcttaggagtgaacagttgtgggtagaagcctaaggaattgtttatctcgagatctttttgagatggaggggtcccaaaagccattccattaggcagaagaggcaaagcttgactaagagaagaaaattctcacatgtgtgtgcctgcacctgtcactgcatgtatgtgtgcgcctgcacctgtcactgcatgtatgtgtgcatatgcagtcatgtacatatgtgtgcctgcatacatgcaccagagcacgtgcatgtgtggccccaggcttgctgagtgctttctgctttacttgggcaaggcagagccaccaccagctgcagtggcttcccacacaaaagctgagatagccccaccctgacacacacatgtgagtcgtctctatttgaattcttccctctgttgtgcagcaatctatttttgtatgagagccctagactcatttgtggttcccgaaaatttggggtttgctgtttccagccttcctctcctgcagcgcagccgctgtgcctgtgtttcatctccctctgcctttgccctgccgatgacacagagggaagcttagaattctccctgctttgtggttctattcacctctgtgatcagttgttttgtggctatagttactctactttgcagaaaggggatttgaattctttggattctttgttcacaaacaaaccagtgccagagccactgcctcttcgccgcctgcaaagtgcgctgcgctgcctgccagcagggggcgggggtccatcctcgtttctatcagattcccggacacgctgcaagctccggggtccgtccctgtgtgtgccttcctcttttgtacaagttacaaaggaggggcttaggttcagggtcgacttaatcgcattcctgtccctggcacatccccattagccctctgagatgctgctaccgctaccttttctgtagttttgtccttccttgcagccccctctccatgtccccatcctccattggtacctactcgaacatattcaacaagtgtttgtacctgcgggagatgggaatggagccccacctggacccccttgccaggtggtgaacctgacactctgcagccctgagcgttggctgcagacagctcacagctgcgggggctggggatggtgacggccgctcttgctgaagggagctgccaggctgagactttgcacaccgctgggtgcgggggagtccccaagccagtgcttgtctgatagaggggacaaaaggccagtccccttacctcaaggcgaagtccaagctgggatgcgtcagagctccaggggatctttctagactttctccaaacccttgttctcgctgagctgcagcctcgcactattctgggtccctcccttacctccgttctcctggaagcttcccttagcgcatcacacacacccaaatcccatctcagactgtgtctctggggacttgcatgaagatgggatctgtgtagaatgtgtagacttgtgtgtgtgcacttgtgcccgtgtgtgcttaacacagccccccatggactgtggatgcctactggaatgatatcctgggcacccacactcttcccttaagcaccgtctgtctgggctctatccctggcacgatccattcatccagcccgctgcctcttcctacccatatgtattccagagggtgctaccacatcctatgcagccacttctctagtgacgaccacttaggtggcctcttcctctacatcctcaatgggcatccttgtgcatggacccttggactcatgtctcagaatctccacatggcccctgggagtgggtctgagtgatgggtgtgtgcaaacttagcttcccagagtcctgcagattgcttcccagggtgcactcatagcccaacaacagcacacaagtgtccagttcccccacatcctctcctgcggcagggaggggcctgccttcccctgtgtgctgttctgatgttaatttttcgttctgatatttttctgttcattgctagtgacttttagcatctctgcatgttgggtgttggcacttccccttttgcaaaccatctactaactttttgtaaaagatttattaattttagatgctctgtttattctagacgtgaatccctcgttttatacaatggaaatatcttctctaagcaggctgtctctttccttgttgttggcatcctctttcagcagaaatccttcagagttgctgccttatgctctcatcgttgtatggaggttctgataagacagctcatttctatttcacctgtcttttgctgcagtcctccagccaggactcaggtatgagtccacagggggctgtgttaaaggacaccgaattacagagaccatcttcacacaaaatcatgcttccctttcgtcctgacccataaaccctacttttgctccctggcctctcttctgtgagtgggagtgctttttctagagcttttccatttttcaggcagagagaccccagatgggccatctcactaaaccctggaggtgccgagactcacttgagccgcacagaaaacacatgtcagcatgccacgcgcatcccctgccgtagtgtaagcaacaggagtctaattcctccatagcctctctggagaggaacttttcatctttgtgcgtctcaataggtccccagtcatgcattgctgctcttatagcgagcaaacaatattccagaaaatgcccagatgcatacacagtgccgagtagcacaagaaggaaagttttatttagtggggtcctctggggacacctggtgggctctctctgagggttggatgcatgggtagttgactctttgaggaagagaattgaggggctggccgtggtttcccacatgaatgactatgaggggtctgcagactgggatcccagggtggtgggcacggacagcggggctggcattgctggcaagactggctcccagcctgacaattgcctaggcctggcttcagcaagctgcttctgcaaagggccagagagtaaatattttgggttttgctggccatatggtctctgctgcagctatccaactctgccaatgtagtatacaagcaggaatgggcactgtgtgaatgaatgaacgtgctgggtttcaataaagctttatttacaaaaacaggccagatttgatctgtgggtcactgttggctaactgccagcctatgctgttgcatgtgcctttagtggagccgtgagctgatattttcacaaggttccaaagtttcacggttgctttggattggcttgaataaggctaaaatcaccaaaactaagatgtagcggatttctgataatgttttcactatactaattatatctgatatataatggagtgcccagggcaagatttaaaatggggagttgtatgggcagctcaccaggatgaaagcagtttgtgtttaagcttgctctgacccacggccccagggccggctctaccgccaccaactcaaataagacttttattacgggttagtcagagcacgtagaacaaatccgcattatcttcagtgccctgaatcaacaccagtgtaaatgagttagaggaatgtcctggagccgaggtcagcgacttttggcccataggtcgaatgcagaacactgcctgtttttgtgagtaaagttgtgttggaacacagctattttagtccactcgtgtgtgctgcaagaacaaaataacggggactaggtaatgtataaagaatagaaatgtatttctcaccgttctggaggctggggagtccaagatgaacgtgcctgcatctggtgtctggtgatggacttctcgttgagtgtcccgtgttgcaaggtggaagggcaagaggaacaaaggccgtgtcctcacccggctccccttgcagaagtgtaagctggccaaatgctgccggaagcttcttttatgagggtcttaatcccacctaagggggaggagcccccatagcctaatcatctcttaaaggcctcacctctgaattccttcacattggcaacacctgaattttggaggagacacgtttgaatcgtagcaaccactgtggccagtcatttgcacgttgcctatgactgcccttgcaggagaatctcagagctgagcaattgcagcagagactgtaaggcccttgaaacctaaaatgtttgctgcctggccctctacagaaacattggatgatccctgcactagagccccaaaggggaaaagaattattaagatctgctgtctctcctttctgatagtgtggtgtagatttagctgtgactgagaatctgaaataacagtgactggtactgcccctgctgcactcagcactgtctgtggtgaacaccctctgtgcctctcattttgctgccaccactgtggggctgccacaggctctggtgctctggttgcctgcaactgtggggtggcggcttaccaatgcactaggtagagagccaggcagctatcctgcccatcgctcacatccacggctcccatcttttcttcctgtgggtgctgacttgtggagggagatgttttcctcagcatgcatgaatcagttaggattcaactcagctgtgaataatggaaaacccaaataacaatgatgtaagcaagatggaatttaaaaaaacaactcatagtggtctggaaactccacaattatcagagattcgactgtttctacttctctctctctctctttttgtatccttagcatatgttttctcttcccaagtttgcctcatggtagcaagatggttgctgaagatcagtagtcacacttctatcccaggtggtatttattttcagggccacagaaaggaggagggtacataagggaagtagggcacatctataaacagaggcagttccatttaaataacttttctggaagctccatcaacaacttctgcttatatcttgttatagattaaattgtgtctgccccacctgacctaaaaaagatatgttgagtcctaaatccccagtatctcagaatgtgaccttatttggaaatagggtcattgtagatgtaattagttaagacgaggtcatcctggtgtcaagtgggctcctggtgcaatatgactggtgtcctcgtaagaagatggcatgtgaggacagagacacagaggaagaacaccacatgacaagggaggctgagattggaatgatgcagctacaagccaagggactcaacgactgtctgcaaactgcagaaggctagcaagtgtcaaggaaggatttcctcatgggtttcacaggcagcacagccctgccatcaccttgatcttggacttctaggctccagaactgtgagacaatacagttcggttgttttaagtcactgcattgttatggcagccccaggaatatatacataactcaatggctggaggtacctgaaagggagactgagaaatgtcatttttctggcccattttcactgtagggaggaattagaggacagtcctggggatggcagtgcagcctctgctacagatgctctggaatgaggcttcagtggaaacttctcatctcttgagcgcttctccaaagcacctttcccctgaaaaacaggtggggatggtagattttactgtggtgctcttccatttggaaaagagtttagttttttcttctactaatttgtgatctctagcttcatttccagaccttcctgatatccaccctgttccataaaagaaacattgctgacctcataattcttatggcttaagttcatggccctcagatgactcttgatggtgtgggtgggagacagcttctgtccctgactctggcagccagccttggccactgtcttagctccctgtggacaagtccagactacctgaggccattgaccttcctgctatacctctttttctctttgagcatgtaattcctttaaggattaaaccttaggagatttccaaaatgtcgctaagctctgcactcctaagttgtgaggacagcctctgtaagtagggcatctaaggtcatggagaggacctttttgcagttaatcttgactaaaatggcaaatagaatgtgatgtcatcaacctgttgacatgaaattaaggctttcttctgttcttcagtcccattttctcttttaggtggctgtctctggtcctgcatgtctgatctcccgctaattcctgtcccaccaccttctcgttccagtttgctgccctaggaccctcttggtttctgattattatggcaagtccaaggagatgtagaaattcaaagtgtggttgtttgaatgaaggcaggagttggattacccacattagaatgagatctgagtgatacctgcaaaggaaagtctgcagctcctaagctgtcccttcattgctcagattcattggaacatttattctctttgattcaatatgaaaaaatgataatttagtgctaacatgatactccaaataactgggtaccaacctgttagttttatggaattcttcatgagagtaacggttgtttgtttttgtttttttttgagacagtctcgctctgttgcccaggcggagtgcagtggcacgatctcggctcactgcaacctccaccacccaggttcaagtgattcttgtgccgcagcctcctgagtagctgggattacaggcgtgcatcaccatgcctggctgatttttgcattcttagtagagattgggtttcaccctgttggccaggctggtcttgaactcctggcctcaagggatcccctacgttggcctcccaaagtgcctggaatacaggcctgagccactacgcccagccataacttttttttttttttttttttttaacccataggttttgctggtctcaggcatacttatatgtcttagtctgttcaggatgctataacaaaatatcatagatggggttgcttttaagcaacagaactttacttcttacagttttagaggctgagaaagtccaagatcaaagcactggcaggttcaatgtctggctagggcctgtttcctggtttgtagacggtaccttctttctgcctcccacgtgttccacatggcggaaggactgagggatcgctatcaatcctctttcataagggcattaatcccattcatgagggctcccaatcacctcccaaagtccccaccttttaataccattaccttgggggtgaagatttcagcatattaattttgggggacacaaacatttggaccatagcattacatccaccttttctaaatgcattaaaactggtaagggatattagcatgtcaggactctttctttccaaagccatgttgttgttttcttccacttttcgaggttgttgcaaactgaattgctagtgattcttctcccgagcccatctcagcaaagaaaataaatttatccataaaacaacaacccaggccactgggtcggcctcgtagcaaccaccacgggggaaaggaagaacccagggcttcctaaggtagttctcggcataaccaccagggggcactgctaaagtgctgtctcctggtcctgggcctcctaagttggggatgatgtggtctgctgtgcaatgagcatctcggtcacaccttgagtgcaattagattaaaatgtgtcaattattggctgtgttccaggtgtttttctgtgttatctcatttaattccattatttgcctgtgtgggaggtatttcgaatttcactttacaggttggcaactaaagtttttgctcatgagctatctcacatcctaggtgcttgtaagaggtgaaaccagttttttgtttttgtttttgtttttgagacggagtttcgctcttttacccaggttggagtgaagtggcgtgatctcggctcactgcgatctccacccctcggggtcaagtgattctcctgcctcggcctcccaagtagctgggattacaggtgcctgctaccacgcccagctattttttttttttttttttttttgagacggactcttgctctgtcacccaggctggagtgcagtggcgcaatcttggctcactgcaagctccgcctcctgggttcacactactctgcctaagcctcccgagcagctgggattacaggcgcccgccaccatgctagttttttttgtatttttagtagaaacagggtttcaccgtgttaaccaggatggtctcgatctcctgacctcgtgatccacccgcctcggcctcccaaagtgctgggattacaggcgtgagccaccgtgcctggcctaatttttgtatttttagtagagacaggatttcgccatgttggccaggctggtcttgaactcctgacctcaagtgatccaccagccttgacctctcaaactgttaggattacaggcatgagccactgtgcccaactgaaacaagtttttaaagtctctaattgtccatctacaaagctctcagtcttaagaacaaaatctacaggaaattagggaaggagagaagcagcatcttgctctttctaggcaagaagttccagctgtaagactggatgctggggacggcttcatttctttcacttgagaaactgaggatttccacagtgcaaaccttgcttaatgtgtatatcagtcagtcaggagaggctcagctgctgtaacagatactccccagaaactaggtggcttgaagtaacaaaggctcattcctcactcagacttcttgaccacagtggctttctagggagtttctgctcaccctaggtgtgcaggttcctggccaatacaatgatgctggtctgggaatttgccagttgctgtgcatgagagaaaaagagaaaaatttaggagggtcttgaactggcagccacatgctcctgtccagaggtgacgctcatcacttctgtttgcaatgtgttgatcagaactagtcacatggccccacttatgtcctcgagggagccaggaattctatcacattcccaggagcactaaggactactgatgaccaccacagagcctctatcagggctgaataattacaatttggattttttttttttttagatggagtttcactcttgttgcccaggctggagtgcaatggtgccatctcggctcactgcaacctccaacgcccgggttcaagcgattctcctgccttggcctcctgagtagctgggattacaggcacccaccatcatacccagctaattttttgtgtttttagtagagacggggtttcaccatgtagccaggctggtctccaactcctgacctcaggtgatccacctgcctcagcctcccaaagtgggaggcctgattacaggcacgagccaccgtgcccagccacaatttggatattttattaatcatgagttctttttttaacattcatttttatttttaaaaacattgcattaagacattctttattttgatttctgagtttctggctctcccgtacattttgcatctaagacccgtgcttgctgcgaacagagggaggataaaaaataacaattttgactgaaattttgttttcatgagagagccctagagaaaagcagtacttacagagaggcaagaatatagttgacatctacataaatattgacagaaaaagaaaaggatgagaaacacactgtaacagaaaagagaaaacaaaaaggaggtcaatttgagattgagattgctgaggtacatgctgctcgggctctttatttagtcagcacatggtataggaaaacttttgtgttcaatttccccagtgaccttccaagtacattatgaagacaattaaaacccgtatcccagaaccacaaagttttcagcgattgggctaatgttaatcagtgtgaattgaacgaaaacagcttgttcaagtaaaatcgattgaaatcttgacgagcaaaaatggaaattttggttgcaagtgtttactttctttttgtaggaacactgttgtataagatttttaaaagtacaaattactggaagcccacagatgcttctgtaagatgccagagaaattaattttggtaaagatctaggatgttttcaatttatcgaactgtacatatatagcaatttaacttatcttggtacttggtatgatttttcttttaaccaatgtcttgaattttgttcttgtgtggatttcatttgagtgtgaatctataaaattgacctagattccttctcggcagtagaattgatctccttttttttcccgatttgccttgtaaaatgcatctgtgaacttgcctgataaagttgaaaagagaacttcttcaaagatcaaaattatttgctaaatgtgtttctatacttggaacatcagtgaaatatacacctaaatatggggtgaaagtaagagaaacttcttgactacaacattgctttaatcttggggactttacgttccttagaaaatcccaacatcccgagggcaacctcacaatggatatgatcactacataagtatccaggaaaataaaaacagcttgagtttttgaggaactctctttttaaaactcttgaagtaccgtgtattgtgctctgaagggtgatgctgagtacttggcattagcttttcttagggatttgttcacatggtccccttcagaagaatgacttggcaaacaaactttgctgtcactgggagtcttttaacaccacctcagtaaaccgcagccagggggctcgctttccccattgcctcactggggaaaattaaggtcttagagagaagcattaatatctgggagaggttggttaatgggtacaaaaatacaattagaaagagtaagttgtagtatttaatcgtagagaaattgtagttgaaataatctattgtatatttcaaaagagctagaagagaattgtaatgtccccaacacaaagaaaagataaatgtttgaagtgatgaatatctcaattaccctgacttgatcattacacactgtgtacaggtatcaatatatcacatgtactccccaaataggtacaactatcataaagtagttatataatacaactacaataaagataatacaataatgtctgttccctgggatcaagcttactaggagaagagggcctggaggcagggaacctaaggacttcccagaactaaatcaagtggaaatgcttcagctatgacaggaaatatcctcttcatttacatagggcgtgcaccaagtaaatgactttgtaactttacttcatcctcttcatttacatagggcgtacaccaagtaaccaatggaaacctctagagagtatttaaaccccagaaaattctgtaactgggctcttgagcccctatactcaggcccgctcccacaccgtggagtgtactttcaacacatctctctgtttgttgcttcattctttccttgctttgtgtgttttgtccaattcttgggaacctggacaccctccaccagtaacactgtggcccttggggaacgagtcattaaaattttaacgacaagtgcagctcttcgaaggatattccagtcaaaggaagagcatcaaagaagaggttttttgcttgggttactggcaatcaaagaatgtgtcactaacacctggacggggttttgaagtactagcaggagttcctcaggttcacagaggagtgctatgagggaggacagccaaggtatgtggagcaggtgcggagaggggggggcacatggagcagagggccttggtgcctctccagggcccttttccggatctgtgaaccaaccttaactctcttgcaggagatggaagggcctggatgtttaggttaccctcgcctcccacaagagttgcccatggttcaaaagccaattgtctccgtcgctaagggtgggacagaatccaaggcacaacctatactctaggggccccttgggttgaagctgagtccgtgaccacccctgaaaatgcactgttgctggcttctcctcctccctacttggctttgcccacctctttctgtccctgcgggagaacatcctcaggaaatccccggggcctgggtccttgctcagggcctcctgggagaacccagcctcagaggatgcgtttcaggacaggaactcccagaaggaccatgggagttgtgtgtttggaaattgtaaatataagatcaaacgaatggatacggccggtgaaaatactttgtaaactacaagtgctttaccctattagcagtaattgttttccatttacaactgtctttcccaacaggccttgggaatactttattgggtcagttcatcctcctcctaccgctgttgccagcgccctttataacattctgtgtgatgagtgcacctgctacctggggaggtgggtggggcgaatgaaagtcgattacttaaatctggatgacaaatgccctgcctttactcccctggattcaaagcttttatttggcccaatggagctttcctggggcttcatctcttagcacattgcttactatcgcagagctatttgttttataaactcaactccttaaacccaatgaaaaacaatggcttcaaagcagctttttccattctgtgaacacaggaaaaaaaatagcagtaaatcagaaacttctcatctgagacagttattttatctttttggcactggcccttagagaacaggaggtagaatccacccgagcccctcgtctctctgtggagtcttccacaacgtgcataacatcccagccgctgtggaacgtggccgaggccagccccagcttgatttaatgctctccgtagctgagtttctttgccccaggctcaataagctgtaaagaatagatcctctgacaaattgacagcttttgcttcagagatgtaaagccaatgggaaaacctacaacagggcaattctctttttattcaattcatttggagaaataatcatcagaataatgatctattttagggaaaggtggatggaaacttaggctatttgtagaattttctcctaggtttaaaataacattatcctaaactcttcctttccttccttcctccctcccctccttccttcctctctaccttgaacttgactacagccttatactttgtgtgaggttcagtgtgaattcagaagagaacttataaaacatctataaaattaaaagaaatcaattggcactgcagccctataaactcttcttccataaaagccattctgtgccacttctcatctcctgggaggcaagagtggtaaaggctcacacttccaggggagggcaagttcaatggcaagctatctgactttgggcgactataatcctatgaatctcagtttgctgaggtgcaaaaaggtgataattatgcctcctgtgctgggtaatagaaagcaaacagataatgccctttcatggaaactagcacatactaagagttaatcaaagataggcattattatcattcttgctacacaaacttggataaacaaagcaagggctgggaacaggaaaggaaagagaaagcttaaggaaaaattagattttttttttaaaaatgcagcattggaagagctatttaaatggtttctttaagtctgttgtggagagaaaactgcatatatgggtgtgggtgggtgcagagggtgggggttgactgacaagagcatcagggtgttggggaccccttcagatacatgagaattccccttggcaatgtccaaagtggaccggaaggtgggagtcaacactagcagcatttttttttttttttttttgggagacagcatctcactctgtcacccaggctggagtacagtggcgtcatcttggctcactgcaacctcggcctcccaggttcaagcaattctcctgcctcagcctcccaagtagctgggattacaggcacccgccaccaagcccagctaattcttgtattttttttttttttttagtagagacggagttacactgtattggccagcctggactcaaactcctgaccctgttatctgcatgctttggcctcccaaagtgctgggattataggtgtgagccactgtgcctggcaagcagcaactattttaatcccaaacacagcttccttcgccatccagttccttcttctcttctcccacctcctccttctcctcctcctctctcttttgtataaccctctatatttcatcagaaatacagtcaagaaggggtcattggagcatgataagcaaacaatcttcacagtcatcacagggccaggatagagttttgtcattttttcttttttccatgattttatattccaccttgtctgcagtcagaaattggcatttgaaaatgcagtttatatggtcctgtttagaaagttagggtgaggcttgcttttttgagctggcaagaacaataaagacctaggaagatgacaggataggggaagaggagctttgttagatgggcgacgtgctgacggttttggaagctgcgttgaaattgaatttcttgcacaaacgtcgtcgacacatgcactttcccatcctcatggcagatgtcataagagaattattggtgtagtgaattcttgcccaatttctcccgctttaatcccattttacacatacttcttggcttccctgttataaaagccagagcgtttttgaaagcaaatgccctaaaaattcacacattctcgttctacagggagacatcgccaaaagctaaaatatccaggaaagggagagatgatgcataaactaatcaccaagaaaatgataaaaattcatcactagaaagtctggctttttaagtatccttttctagattcagttttttaagaaccaggtcaaaacctgatactttggaaggaagaccttacaaattacattggaaaatcctggagtgtttatgtattaccctcattgcacctgagaaaaatcttttgaataaatatatgtaggtactgcatctctgaataattttttgttagggcaaaagatccattaaggtaaatatcatcaatcagacaattataagtattcaaaatgattgattctatcgaattaagagtgatttcagggatatgaaactccttaattcacacattaaaaaattttaccacttatttttcattaatgtacagtaaaaatgataataaatcaagcagatctcagtttgaacagaggtgattgtagttgatacttaaaaaatagcctcattaagactcacgtttattaatgatctaccctgtcacacacactggccaaagtttgatctggagtcctagcatgtatgtattgatttatgaacctgctttggattattacctgagcagagaaattgtattcagccacagaattcaggctttgaattttggaactttctatccagggtccagtaaatgtcagcgtggaaggtaatgggccaggcaaataaacccccgtcatgatcatgcgggtgggatgatctcgctgtagcctgacttgggtgagttagtttacatgaagctgctgcctgaattcgctatgtggccaggctttgccaacatattcatgtgtaggaagcgtggacgtttcctctccagtgtttgaaaatcttgtgtgtgagtttcctatgaatgccgtaacaaattgccacaaagctggtggcttaaaataacacaaaggtattctctcacagctctggaggccagaagtctgaaatcactgggctgaaatcaaggcgttggtggagccacacaccccgctggaagctccagggaagattcatttctttgctttttccagcttgtcgtggccgcctttgttccttggtttgtagctccttcctccatccacaaagtgcatcacctcaacctctgcctctgtctctgcagtcacttttccttagaaggtcacactcacagttccagggatagcaacttggctatctttgggggcctttattcagccgaccccatcgtagaatacaaactatgaaatgtgaccacgtccttattaaaaaccagtcgggtgtggcgtcttatgcctctaatcccaacactttgggaggccgaggcaggcagatcacctgaggtcaggagttcgagaccagcctggccaacatgatgaaacaccattgctactgaaaacacaaaaattagctgggcgtggtggtgggcacctgtaatcccagctagtcaggaggtggaggcacaagaattgcttgaacccaggaggtggaggttgcagtgagccaagatcatgccactgcactccagcctgggcaacagagcgagactgtgtctaaaaaaaaaaacaaacaagtaattctagggcagtttacattttatttaaatttcttaaactaagaaaataatatgcacatggtaaaacaaaacaaaaaaaccaagcagtacaaatgatggacaatgaaaagtgagcgggcctttcactcctgacggtgttctgtggataggaactgccctggctttacaactgaaggccccacatcgcaggaggtccctcagtcccagacaaaccagacagcagcttaccctgttccagttccataccctaccccagagcttgccatagttacttgttttttgtgtatccttctgaaagtttccacatatataacacaaatttttaactcaattggaaaatacctttttaattatcttggcatttttttccttatcggcgcatctagttttatctctctccctcttttttttttaatccattatgtggtatttcattgaatgaatgtaccatgattcattaaaacattcctttttaacagtaaacatgtgaattattttcaggactttctttgccactacagtgtaatttacatcattgtatgcatatttctttccctatatattgttagtttattgctgaacatcattccattgtataaatatactacaatttgcttccttttcccttggtaaatagacattttattgtttccagtttttggctatgaataaagctgctgcatttattataaatttttgtatgaacatacgttttcatttctcttgaataaataccaagagtagagtggctgggtcgtggagcttttgcacggtcagctttacaagaccctgccaaatacttttcaaaggtatttgtatacattttctcacctgccagcactgtatgagagtccagttgccctacattcttgccaacacatggtattgtcagtcttttccacattagccattcagatggatgtgtaatggtatttcattgtggttttaatttgcattttttgatcacgaatgagtttaaatgattcttcattggtttatcggccatctggttgtcttcttaaggagttgcctgttcacgtcttcttcctattgttctgtcgggttgcctgccatgttcttagtgacttgaaggagttcttttcatattctggatataaatcttttatcagattgcaatggacaaatgtttgtgtcgcccccaaattcatacattgaagtcctaatccctaatgtgatagaattagtaggagaggactttgggaggaaattagatcatgagggtggtaccctcataaatggggtcagtgccctcatgataggcacccctgagagttctgcctgttgtcgccatgtgaggatacaatgagaaggtggccatctgttccaggaagcaggccttcagcagacatgaatcttccagttccttgatcttaaacttcttagcctccagaagaagtgtgagaaataaatttctgttgtttattaaccacccagtctatggtattgtgttataaccgcctgaactgcctaggacatagatgtatggactgaaaagattatttctccctgggttcccattcactctcttactagtgtcttttattgaacagaggttcttcatgataacctcttccggtttatcaaacttttttcgtggtcaatgcccttttaggtccttctggatcatttttagaaatctttggctattccaaggtcataccaatgctctcctatgtgatctaggaatataaaccacctggaatttattactgtgcttgttgtgagggactaagactcattttttaaaatatgactatttaattgactcagcaccatttattcgagggaccttcttttccacatcactctgtaatgccgccttcgtcataaatcaagtgaatgtatacctgtgggtctttttctagactctctattctgtttcactagatgtaatttgataaaggaaaaataaagaattctgacctttcttgcatctgcgtgccttgaagcatatttgtaccatctggataacatcgttttgatcagaatatgcccaaggagtgttttgagtgctttaacttgttcccttcagtaagataaagtgcttcagttcatcctaattagcttctctatcctttttccatgttttaggaggaaataagccagtgacagctttgggggagggtctctcgggaaagcttccactggagagtactctgggccgggcctgctgaagtcaggggctctgcccgggcattggcctgtttctccagcgttcctcttcttatcatgcaccagcttatttcttcctggctcaacataaccttgatgtttttttccaagtggtcaaaaccctgtctgttcattctcacctttgctcatcctgggtgcctctcccagcaaggcctctcccctgttttgggtctacacaaagtttatcccccagtctgatgtcttctataaagcctctcctagtcacgtcagcccttatcaatctttctctcctcagaaccctacagctgctgttatttctgaatcgcttgttccggcctttgtatcattattaaatatttcacaagtgcttgtcttgtctctcaggctggaagcccagctctgcaggaggtggaagcccagctctgcaggaggtcaaagcccctctcttaaagcagttgctcaataaatatttcacccaggatgaaggaaagcatggtcagggagtgggggcagcggggagtgatgtgctttagggtgctgaggtgcagaggaagggcctgctcccagtggggaattcagacagtgccccacacgccccaaatgcctggcgttcatatggtgtcggcttattgagaactgccctaaaaccctcggttcatgtttcaaagtgtgactcagaaaagacaccagctcttacatggggcagagggtggcataacttgggatgataagacaactcagttctgagtcagaactttcatttcagtggaaaatggaagcaacgctgacattctccttccacctgagagcaagcctgacaccaagaaagctgtgggaataggagggatgggcccggacaccgccatctccaaactgctcaagatgtgtcatctgcatagataaactggcacacctgtggatgggacatcctttaagtagatgttaaacaagatccaagattggcgtaatgagccttcagtggactgtcatgattaactgcgcatgctggctggcacaccagagaaagctgatgagttggaggtaaagtgagacaaatatggaaagacattccagttgtttgggggatttttgtcacttcctccagatggatgattttgggtttttgtccctgggtcttgatagatgttctccacttaacttccctgaggtttctggcaggatggagggaggtgatctgcagtctgtttccctattaaaaaccatttccccggacttgaaaagttgccaactcagtcgtctctgatttactgatttctaacaagtgtgcagtgtaaaaataaagcccctggtcggtttttggggcgacttgcatcatttgtagtcacccgatgatgggtttgctgtttgctatgggaacatcccaaggaactcattaatcatttcctcctgaatatcccttaggtcccaagcagaggtgaatggaaatagaattagatggcataatgcatttctgataacaacagctcaagactcacggcttaagagcctgaaccttaaattccccctagtgttccctgagtggagagatgtttcaccccacaggggtcctagactgtgcagagcttctccatctgcccagagagggtgcttagctcatcagggactgcagagggaagctcagccaagaggaagtatgagtatgttaatgggaaagtgagccctcgccgcgtgctgcctgcccctaaaagctgaaaaagaggaagtattatgtcttgggtttaggaccactgggctcccagctcctggtttttcatgcagtcccaggcttgagacctcctccctggtcctggctcagagcccaagtcttaccctggactaaggaaaagaatgccacatacccctccccacaacatgaactcccccaaatggtgccaaatatgcacaatgggaatgtatttgtctcagatgattttgagaagctctggttatttatggcctttagttataaatcaagcaaaggaggtatctgataacaatccttcattgaagaaggaaaggcaggattatggtatggagtccttcattcacttctcctaggttagagaccagagaagcctggattactcatagcaaccattcctatatggataggggatgtcagctgctggaaagggccattgtattaacctggtgatcaagcaaaacactgtatgttgctgtacaagtcagggttctccagagggacagaactaataggatagatgtatatatgaaagggagtttattaaggagaattgactcacacgatcacaaggtgaagtcccacggtaggccgtctgcaagctgaggagcaaggaagccagtagtgactcaatccgagtcccaaaacctcaaaagtagggaagctgacagggcagccttcagtctgtggccaaaggcctgagagcccccagcaaaccactggtgtaagtcccagagtccaaagaccaaagaacctggagtctgatgtccaagggcaggaagtatctagcacaggagaaggaagaaaaccaggaacctcagcaagccagcttatcccaccttcttccacctgctgtgttctagccaggctggcagctgattggatggtgcctacccacattgagggagggtcttcctctcccagtccaccgactcaaaggttaatcttctctggcagcactgtcacagacacacccagaaacaatactttgccagccatctaggcagcattcaatccaataaaattgacacctaatgttaaccatcactgttgcttacctcagtagcaagatcactatattgacggttttagtgctatctcaaaaaggtggggcaggggctgaggggcaagggcggatgatttgtaaagtttttagggttagtttaaggtagttcgttgaatgcaggggaaaggagatgctgattgggatcaggcaaaatttgtgatggaatagttcaggcatggtgggcacagctagacaaaagtttcaaggcagacttgaggagtaaatagatgtgtcataaacccagcagagagatctatttttccaagaagtgggttactaccccgatgagggcaagctgagtagtctactgtttagatagattttcaagaagttcttaaaacaaaataataaagtaagtcttcctcagtaagaattccctggaaaagtaatgttaacatagcctgttggagtaaagtggtgtcaatgtaagcaagaagctgtgtggctaaagacagttttaccattctaccctttgcttataattttagcatctgcgtggagggagggaatgtctatgtggttctcagctacctaataaatgtggaggatatttctcaaatgggataagctgaaggcaagagtagaccaatcctgatgaaatcgtgtttctttctaagagagatataggaaggagaggcaagaaaagaatctcttcaatacttctcatgtgatgggcactatgttcacaagcattttctcattttaactgttacgctgatcttacaaagttgatattattcccgttaattggttaggaagactgaggcttgaagaagatatgtaccttatgttaaagactccccttaacctaactccggtcaggctcctctaagccctcaaatccccaaccttgggttctatccttggcctttttattccagttttagcaagaattctgctgggtcagtttagtgaaaatctcccacccttgatacttgatccatttcctcatcccccatcctggcctccctttagcaataatcctgtcacgtcaatctaacaagaatcctttagctttcatgtttcctcttaataattttttacccactgaccctcactttgctccttggctaccaattcgcacttgcccttgttgactgtagagttgacgccatctctctctcctactgcaaagccccacgatagggtccccttgaataaagcctgccttcccattattaacatgtgtcatatcaatttttcttaaatagttacacagtcaggaagtggagaagctgggatgggaacctgtctgtaggtgtccaatcttgagctacgcactgtgctgtcactatgctggtgcaatggaggccacccttgtgggctacactcccatcctgcgtcctcacaccatctgctgtgtgggccttcccttggctactcttgggagaaaccgagtgtcgggcctggataaatgccttgctctccagggtcactgcatcctgctgttgcatgtgctggtcttcccatagtggctgctgctagagttctcaatgtcacccctgctttaaagtcctgaaggacctcccctcaccagtagggcaaaatctaaattcctctgtgacaagaatcatcactagctcaattttggaatggtagaggagccacagaaaggatatgggagaaaatgcaaaatccagtggcatattattacaattatgatacagctgtgttcaagggtaaagaaacatggaattcattgatgtagcgataaaaacagcttgtaaataatcttttcctgcacaaatgctcatctcctctgttcccccaccttctttgccaccacctttaatataccttggactatttttttttttctcacaggtccctcacctctaaaatctccaaacctttctgctaagttatctccttctgataacatttaaaggctttatcctgaagtctcccacatctggatagccttctactagagagaattaagctctcctgtctgtgtgcccttcagaatgtaaccacgtgatttccccagccctgtgtcctacccatctccatccatccatttagccatctcaccattctttaatgcatccatttgtcaattcatttatttattttttcattcattcatccttgcatcccctactccttccatttatccatggaggaaatgtttgtttaaaaccctatatgaaacctgatcctggatttcatcttcttttggatcagattggcctcattctgttccaaggccacagagtcaagggacaattccagaaaaccatctcaggagtgtggctctcaatctcatgttgcattttatgttggatcggtccagcctctcctcggtacagcactgttaattgttttctcaaccaagggagatccaagacagtaatgttcagtctgattttagatgaagaatccaagacttctgccatggtcattgaagcattactccaaattgccaagatatggaatcaattatatcttgatatgttcctcagtggatgaatggataaagaaatatgtacatacacaatggaatactatttagccataaaaggaaggaattctgtggtttacaatgtggatgagcctggaggacattatgttaagtgaaataagccagacacagaaagacaactactacatgatcttacttatatgtggaatctagaaggtgaactcagaaacagggagtagaatggtggttccagaggttgtggcagggtggggaagaaggggcaagatgttggtcaaagaatacaaaacttctggtagacaggaggaataaattgaagagatctgatgtacatcatggtgactacagtttaaaaaacaatgtgttgcatacttgaaaatttctaacagagtaggttttaagtgtttttgctgcaaagaagtaagtatatgaggcaatgtatatgccaattagcttgatttagccatgctgcaatgtgtgcatatatcaaaagacaccataaatagatgcaatttttatctgttgattaaaaaaataaacaaaaacaagaaaaaaaagaatccaggtgtgctgggtcctgcttcttctgacctagagaacacccagaataagtgcagtggtgccaaggaccgaacagttaaagtcagtgcagctatatccgttaattttagctttaggagggttataaatatagagaatcatgcatatttcaccatcaaactgatactcaattactcttttttttgtcatctcaagagcaaatgaactctggtaaatggactgagaagagaaactttggaaagtgacaccaagcaatcagacacagaaaaaatgaccccaatgtttggagatttctaactgatcattctttcttagatgcctcctgtcgtgggaatagaaaagagtgggggataatttttgactttgctttaaaattttcataataggaaaaggctcccattctaattcaagagatgacaccttaacaacctttctcctcataaaacattccccagctccttgtggctgttgcgtaaccaggagggtcctgccatgaaatagaactggagtttcttccccagtcatagccacacttcccaagggaactggatgtctgtgatcgttatgaattaaaggctcagtcttcattacatcagtgtcagcctgtattaacagatctcaacattttctctaaaggcaggtatttttatttgtcgaggaatcaggactctcttctctgattctgacttacagcctgcaaatccagtgtgcacggctcatttttcttttccttctccactgagattggcttgtgtgactattccattcatcaggcatggagtgagggaaacgcacacttcatttgctttgtggccactgccttattttccctattttggtctgaaaagaaccaataaaccttctatcttcaaattttcagaggagtactttccatctagctggttcttgaatgctttaaaatggaaaaaagaacagaaaacaggttgctgtttgggtgatttgcaagcgctctgaaattactgtttttctgcttcacagactcggtgactgacagtgccttcccccagatagtcagccagtggcattggccacgacggtgctgctccaaattgagtatttttttcttaatgtcagtgtctactgaatgaaaactagaattaatttttcatgggctaatagttgtgcatagctacagtgtacctgctgagtttacggactttgcaaataacatttagtctcctttttttttttttctttttgtcatccctggtctctggagaattttacttttcgacggttttagcccttcctcatatctggctgattttgataagagcagatgaattacccaacgtggaatatgagaaaattctttgtagagggggtccagtggtcataggtgcatttgactggggctccaatttgtgcacagcccccttgtgccccagctgtgtccggggtgagaagccactggcctgaggtcactgtagcacacctttcctccctatagaccaaggtttctccctcttggcactattcacatttggtttggggggctgccctgtgcattattggatgtttagtggtaccctggcttctacacattagataccagtagcactgtttccccaggcggtgacaaccaaaactgctttcagacattgccaaatgcctctggggtggtgatggggaatggtccccacatgaagatgttctccctctgggctccttgagtgagagtcccaggtgagagttgggatgaatgcagaaagaggaggaaaagagggcaggaaatcaggaaaaagatggactctggggcgcgtcggcctttgctgagatccagatgaaaaaattcgctggttacctactctggctaagtgttagaattacctggggagctttaaaaaaatccactgtccgagcctggcccaaggatcctgaattaattggtttgaggacgtaccctgctatcagcattttcttctcaagtccccttggtggctgtaatgtgcggccagggttgaagaccaaggtcaggagcagagtcgctcactgtgaggccgtgctcgtcctgccggcggctgcatgaggccgggagctgtgctgtcgaggcattcactttaccttcctgaatttttctcaacaagtgtcttcgagttctcgaagctgagaccctgggcattactaatgtcacctgggctgctcaagtagctccttcgaataaccaccaaaagaactcaaccccagcttgaccaacatggagaaaccccgtctctactaaaaatacagaaaattagccgggtgcggtggcgcatgccagtaatcccagctactcgggaggctgaggtaggagaatcgcttgaacccaggaggcggaggttgcagtgagccgggatcgcgccactgtactccagcctgggcaacaagagggaaactccgtctcagggaaaaaaaaaaaaaaaagaactcaaccagtgaaaaaagcaggccccacctcagtcatacatagacttctgctgcatttcttagaaaatgctcctttgccttcttttgccagcaggtgagtgcacgcatttgtctaagcgacagggaactgcccgtgcaaggaaggagggccgagcgggtggagagggatgtggaaatgggagccacctgcgatgctctgtatctccctgtagggatggcagtagctaaagaatggtgagaaccagaacaccagagacagggagggagagatgaacaaccaggtagtcatctaacctcaaataacagcataacagttataaacagcaaattctaccaagtattcaattaaccccaatggaaatagaaaaggaggagcagagaaaccaaaaatagatgggatgaacaagaaacaaatagtaaaatagtagatccgaatcccactttatctttcaaatgtaaatgtaagagcccatcatgtgtaaatggactaaacactctaagaggcagaggtagtctggatggatataaaagcaaggcccaactcaagaaagcaagatgtgctttaaatacacagatatagataggttgaaagacatgcaagtaagtaggtgttaaaagatgtaccatgcgtatagcgtaaaaatactggggtagctatatattaatatcagataatacacatcacaacaaaaaatattaccagagataaagagggacactttataatgacaaagggtcaattaatcaggaagttaaaacaatcatagatgtatatgtcccaaatcacagatcttcaaataaaaatacacatgactaatttaaagcaaacgttataccatgccatgtggaatttataatagatatgatagctacagcatctaggatggaagacagatcaagtgaccagtaaggctgcaagtttcattatgttatatgaagtagtaccttagaagtaagtaggctgtgcactatgtaccatagcaaagacttggaaccaacccaaatgcccagcaatgatagactgaataaagaaaatgtggcacgtattcaccatggaatactatgcagccataaaaaaggatgagttcatgtcctttgcaggtacatggatgaagctggaaaccatcattctcagcaaactaacacgggatgaagctggaaaccatcattctcagcaaactaacacaggaacagaaaaccaaacaccacatgttcccactcataagtgggagttgaacaatgagaacacatggacacagggaggggaacatcacacactggggcctgtcggggggtggcgggctgggggagggatagcattaggagaaatacctaatgtagatgatgggttgatgggtgcagcaaaccaccatggcacgtgtatacctatgtaacaaatctgcacgttctgcacatgtatcacagcacttaaagtttaattaacaaaaaaaagaagtaggctgtgaaaagataaagatgtatagtctaatccctagaatgaccacttaaagtgcaaagataaatagttaaaaaatcaatagctgtattacagtggcattctaacaaatattcattcaacacaccaatgcacacatactcccactcctcacatacctctttcttttggatgatggaatctaccaaacgaataataacatagtggatctttcatgaaggcaagtacttccttagcttttctaatataaagtagctccataattagttgtaatttcggtaaattattgcccattataaactgctaattcgatacatgttcattcctttccgtagctaatttagaaagtcttcacagtggggttgattctggtttgtggattttgtgcgtctggttttgtcaagtagaatggtccaactatcagttccaggcctcagtagaaagtaacccacgtagtctcactttcctgaggatcctcaataaacttcctagaagatgtaactcttgagatttcctgaatgctgagttctgccagtgacaggtgtaatcaccgtttacattcctgatgttagtagagaaaaatgaggcaggcccattggggaactcacacaggaatagacaatgatttaacgcataacaatgtgatgatcgtggctttgggtctggtcactgtttccgtgagcatgtaccaagatggtatgagctgtccttgcagcaagatggaaagtgcattccactagctcccttagaccttctcgcatggattgtggttccctgtgggccccccacatcctgtattcgtttgattgacttctcagtcaagtctctacatttgttttattaatgtcactttgaaatcttgtcaagaggcaggcatggtggctcatgcctgtaatcccagcacttgggaggctaaggcaggtggatcaactgaggtcaagagttcgaaaccaggctgaccaatgtggtgaaaccccgtctctactaaaaatacaaaaattagccgggtgtggttgtgggagcctgtaatcccagctacttgggaggctgagacaggggaatcgcttgaacccaggaggcagatgttgcagtgagccgatatcgtgccattgcactccagcctgggcaacaagagcaaaactccatcccccttccccacaaaggagttaattggattaaaatgaatgagaaacagtacatagggagggtaggtgagagctctacaggatagatagtaattgaagaatgggtaaactgttaacagaggtaggtgaatgaagtggagaaaacagtgtaattaaagacatagaggtgagaactcactggaaagtgatccaggctcaggaagcaagggagctggccagcatgtggaggtggcattggaggtttgtggtaaggccagagagatggacaggaggcagattctggagggctttgaacacgaagtccaaacttttgttacataacttgacacaaaattttgaaaagcacttttttttaagctagaaggtgtcttgtttggggctaggctttaggaagatgcacctagcaccagtctgtgttggaggaattagagagaggggaggggttgacatgtgacctggctcctcttttgtctacatgaaaggatttctggatggagtagggcaatcactttccttcctctccggcctttttctttttctttctttttttttttttgacaagtggatggctgcctcaaatgaaacaccttgaaaactcaaaatgtcagactcaaagagtcctctcccacattgagagctttagagagctagtgacaggcactcagaaaagagagcccatatggcctgcttcagtaaagggatgcttgagttgttaattcctaaaaaaaccatcgtccgtgtaacagttgcttccatgccctctcagcattgaaatgggacttcccattattcctcaagtcttctctcttccctctttaattcacaaaagattttctgagagcttaccgtgtgtcaggcactgttaggacttggaatattctatttagttctttttctaaaaacatccattgctgtgatgatgattattacatatgtgatatatatcttattattatccttgcttcagtttacttatgaggaaacagagactcagagaggttaagtaactttctcaatgtcacacagccagaaggaaaccgagatgtggtttccaatgtcttgtctggacaaattaaatattacatgaagaacatcataacaaaaaatattaccagagacaaagagggacactgtattagtctgttcttatgctgttaataaagatatacccaagactgggtaatttataaaggaaagaggtttaattgactcacagttccacatggctggggaggcctcacaatcatggcggaaagtgaatgaggagcaaagtcacatcttacgtggctgcaggcaggagagcttgtgcagggggactcccatttatgaaaccatcctatctcatgagactcatgcactagcacaagaacagcatggaggaaaccacccccatgattcaattatctccacctggccctgcccttgacacatggggattattgcaattaaaagtgagatttgggtggggacacagctaaaccatatcagacattttataatgataaagggtcaattaatcaggaagttaagacaatcataagtgtatatctcccaaattacagatcttcaaataaaaatacatgtgactaatttaaagtgaacattataccatgacatgtgagatttataatgtatataaatacaaacattataaaaagtaacatgtacaatagtaatgtctgtaatacctttacatacaattactatactatttaatatcttttgattatcaagtggttactatgtcccagcactttagacacatacattaattctcacaaccccattataaggtattattatcccaaaatgtggcagagagagctaagattactgcctaagttctcttagctagtaattaagtgagctggattgaactcttagtaagtggtatggggtgtagacactggaatttgggtttatctgacccaaaacctgtggttaaatttgtttgaagaagagtctaatgatcatctacctcttccaccatttacctaaggttttctgagcacctacaatgttctagacactttacatgtgatcacatttagtcctgaactctgtgaggtgggcattcttctcctttcaaagaatggggatccaagtctccaagcagcaaaattattcaccaggatcatttgccagcaagtggctgatgagagattaaaatccaagtgcgtcagacgttagatactgcttcatacaaaaatctgtctttcaccaagaaaacccatgcttcaacagagttacatagttctccattttgttcccacaggctagactaggagggaggagctgccccgaaggcctgggtttcttcttagaccctctcaggtcaggttcaggggatagcatttctctctggctgagaactgctatagagtttccatgtttcatataccatacaatgatgttaaaaaacacaatttcaatgtatttagtttaaaaatttaattggcttttgttagcaactcatgaattgggcagcctctcatctaaaaatggagagacactccattaggcatggccaaagtggatttttataaagtagcttgagtaggaacaaggaaatggcataatctaaaaaggggattgggaaacaccaggttactttacttgtaaggggtaacgtagaggaggcttccttatcatgctgcctaacactcgaccgtttgtggatttggccaccatctctctcctgatttctcagaaggtcagataaacaactaagttttggtttggtgatgtggaactttagcataagtgagtccattttggtttgatctgctggggcctagtgcagaagctcagtccatatcaataggctctcgtaaattttatttaacagtgattaaaatgggaaaccattaaaattaaaattatagcaactgacttatgagaaaatgtttattacgtactgttaagtggggaaaggcaggatgcaataaagatctgcataaaatagaaatgcatatctacagaatctggaatgaagtacacaaaagtggagagtgagaaaggtcatattatgggtgattttttggttggggggggtgccatttttgaaattgtctttagtgttccttctcagtatgggttttcatgtagggaaggggatttgtattggagagtcacatattaaaaacatataaatcacaagttgtattagtccattttcatgcttctgataaagacatacctgagactgggcaatttacaaaagaaagaagtttattggtcttacagttctacatgactggggaggcctcacaatcattgtggaaggcaaggaggagcaagtcacaccttatgtggatagcagcaggcaaaaagagagagagagcttgtgcagggaaactcccatttttaaaaccatcagatctcatgagactattcactatcatgagaacagcacaggaaagacctcccccatgattcaattacctcccaccagcttcttcccatgacacatggggattgtgggagttacaattcaagataagatttgggtggagtcacaaccaaaccatatcacaaatattcatagctctctgaattttcccagactgaacaccctgtgtaccaagcactcagatcaagaaacagagcattgtcaggatccagaaacctcgcatcctccactcctattattcttaaagtaaattagaaaaacccattctctgagcatggaatggattgctcttaagtatgcaataagaagatcttggccagaaagccaaggaagaggaggctgatcacttgagtcagtaaggactgagccttcctggggcttcctactcatcattcattcttactctggaaatagcagaggtcgggtgggccgttttcagaacaggagctggtaacttggttatgcacctaaccggaaacaagaagagaaaggggctggtgtctgtccaggagatgagaagtggtgctgaggactagcccagaaacactatcccccactgaagttacaggcccagtggagctggaaccccagagcctgcagagaacaaacactgatgggccttccagaaagagagacaaggctcaagagcataattcagagaagtgaacagaccaaatagacatagttcaaaaacaagggaacagcagccaagggcctggagccagggaagaaggggttgacacccagaagttgggccctggagttacacagaaaagtgcttccagcattccttcagtgctcatggagcccctgttgcctggatgcagtggtgaatgagatagaatgagacagatgctgtggctgccctcatgggcctgatatccacagagggatgacagctatgatgggggagccaggcaggggaggggctgtgtgttcaaggctgtaggaatgcacaggtgaaaccccacctgaaggccaggtaaagtgcgcatgttgagtttggggaacagaaagcccatctcatggcagaaacagagcaaactgggagagacggattggactggagtcacagccagctcccagggaccattgcagggagcagaagcacaacatcccaacatgtctccaattggttagaaaaccaggccgggcacggtgactcacgcctgtaatcccagcactttgggaggccgaggtgggcagatcatgaggtcaagagattgaagccatcctggccaacatggtgaaaccccatctctactaaaaatacaaaaatcagctgagcatggtggcgggcacctgtagtcccagctacttgggaggctgagacaggagaatcacttgaacctgggaggcagaggttgcagtgagctgagatcacaccactgcactccagcctggcaacagagagactccgtctaaaaaaaaaaaaaagccagtgacgttgcacactcagtaacactgcaaatatgcaaatataacaatttgcaaacatattcagaaatgccaagtaaaatgtaaatttataaaactataaatgttaaaaatatgtgatcatagccacataaattctcagcagattaaatgaatacaaataaaacattagtcaaaaaataactattgacccaaagtgaaactaatttaagtaaccgtgaattttgattcacgattataaaatacgatgtaatctttcttttaaaatgctgtataaaaatataaaattgtctcaacagttcatttatgagcttttttgagggcaaattcttccagctactgaaaaatatctttcttaatctatatgcaatgagttgaagaaacagtggtggactaattctaagttaataaaaaaagttctttctgactccagaaaaattcaaataattctatttcttatttgataattttaaagatatatgattgaacactctttttttcaggaactgcactctcattgctgaagagctgctatgggttgaattctgcctcctccaaaattcatatgttgaagccctaacttccaatgtcactgcatttggggacaggtcctctaagagggtgattaaggttaaatggggtcataaggatgggatatcagtccaatatgactcacgtatcataagaagatgaagagacaccagggatatgcacacacagaaaaaaggtcatgccacaggtggacacagagagaaggcagccatctgcaagccaaggagagaggcctcaggggaaaccagccctgctgccaccttgatcttggacttccagcctctagacctgtgtaaagataaatttctgttgtttaagtcatccagtctttggttattttgttatggcagctccagctgactaatccatgagttatatatttggttgtcatttctaagagagtatgttatttgatctttgttggctttgctttcatcaggcatagatggtgaatccagtgcagggtgactataccaattttcatactatcatttttttatccaatttgtttggaaattataaaaaccagaggaagatttgttcttggaatggaaactttgccaataccacaacatgattgcttaccctggcttactctggcagagacttgtttagacttgcagtttggttatagttttgttgttgttgttattgttgtttatcttaattgaataattgagtcattgatgttgagcaaaaaccaaatgattcagcgttcatttatgatttaaaaatataaaaataatcattttacaacaaatgcattcacttcttagtacttgaaaatagcctagttattaaaatactaaaacacctaaaacccacttactggctgtatatgtgggagcagcctctctaaatttctctgaaattcacttttcttagctatgaaattatatttttatatatatatatataaaatatacacacatatatacatatatgtgtgtatatacataatatacatatacatatatatatacatacacacatatacatatatatggaatagggctgtggtcaagatgagaatcatgcatgtaaaatgttggacaaagagcccgttggtagaagacattgggtaactggctactgttgctgtctcaagacagcacaaggtgcaggtgttctgggaccctgggtacatgggatctatccacagctttgtcatggagccagaaaagcagaattcaggttggctggagccacctctggcaactctgggaaatggccataaccactgtaaccaggctgttacgtaggctattatttggtttgtcagggacccaggggccaagaacccagctgttcatacaactaaatgtgaaaagcaaggttgacacagaggaggacactctaacaattgtgcaccaagctaatgttttcactaagaagttctgtcattgtgcatgagtttggttctgctccaactttatctgcccaagaaatgaaggcagaatggttgggatagggtgctttagagatgggttcaggaaagggtgagtcagcctgccttgcttgcagatgagcatggttttatatctgccctccatcagggcggggttgctgggagaaaaatgttcgtctccacatgttggccaacacagcaaggctgtctatgtgtcagactgttcctaggcaaaatctaggagtgcaaagtaggtgttgcctgtttttgagccctttattcataatgttggggcctaaaagcccagctgcccccattggtgtccctagaccccttccgtgattgtcctgtcactaattggagccccattgggtccttccaccaactcctgcctgcagtcctgtcttgtctcctttctgtcattaaaaccttcccgtagagcattcgcttagcataatgctccccttcttgccaatgcctgccagtcctgactgcacgaggaatcacccagagatctcatttaaaatctcaacacctgagccccacccggaggacctgttgatctagttctgggaggcagagcttggaagcccatatgtcatccagtgcttggctggttctggtttgtagttgggtctggggactcagctctagcagaccagggagataatgagctccagttaagtcagccaatcctagagactgcagtagctgacacagcagcactcttcctagaaaacagaagtccttgtgccagttaaaaatctcagaggatcttccagagtggggtcattggagatctcagcatggtggtctgggcagtgtaggagggcgacacggacaggctggaaaagcttggctctttctcaagccaatgctgattaggggattcatctgtggggtataaatggcaaaagagtggggacattgtgatatcatttctgtgtgtgtgtatccatctccctcccctcagtgacctagagtaccatgaagtggaaactcaaagaattttggtatctgctgggtgtgggataggacgagggattggtcatattttaggtactgattcattttggacagaaatgggagttgagagacactcctttaggaataacttggaaaattctcattaaaaataatgatgatgataataaaacaacttagtgctttccacttggctttatgtaccggatgatttaatgcaacaatgatgcagccgtgcatggctggccgatgctggaagcccccaccccaccccaaaacatctcctgactagcctaactagccattctatgcactcaatactttaatttgcaccttctattcattcactcctaacctggtgacaccccctagattactgatctctgcggttcaatttcttcatctccataaacgatataaatgcctagggaatcccagtgtgtgagaattccaactctctctctctgtttccacctggccagaagtgatgatcacaaaatgatacagaacagaatatatttttctagacttcacttccttgcacaaaacgagtagtgaaacaagtctctgaagctgtgtctctctgaaagggtagagtcggaatgcgtgctctgtggctgtcttatttgtgtttccaggaggccagcctgtttgtattctatataacatatatggcactctcccttccttaactcgattctccacacttcccacacactagctttttatttttatttttatttttagccagaaagaatgctgtgtttcttgctgttttcatgttcgcattagaggaacagcagcacgctgtcaggggtggctggtaatagactctggataacaagcacccagctcagcctggggctccctcgggaaacagaattggatgatggaagaaaataatgtcagggttcagggaggaacgtctcagctagcccatcacataaacattaaaaataaaattagaatacatgccttatgattcctcagctggagaagcaaaataaatggaaaaaattatccccaagccgtaatagcttggctccaaagaatggcttctttcctctcaccgggttgcagcatccttcccaaacattgccctcgtaagtgtccaggaactgtgacctggaggccctcaggatctctccctcaggccaaggcaggcaattacatcagcccaggggtttggtttcaagttgtcaggggtcagtgatgcaggtcactcagttcccagggcccttcctgagaattggtgctgggaataagtaggatggatagaacatccagttgggatgtctagcaccgatttggatgttggcaccaggagccaaatgacctagtttcaaagtccagccctacaacttactaggactctgagttacataacctctaggtgcttcaatttgcttatctgtggaatgggagtgaggtaaactccaccggatagatacattgggaagcataacaaacttaatgcatgtaaactccctttttgtttttaatggagatcgggttttgccatgttggccaggctggtctcgaacgcctgacctcaggtgatccacccactcgggctcccaaagtgctgggattataggcatgagccactgcgcctggccccagttttcttttttttctttttttttttaggcggagtgtcactctgtcgcccaagctctggagtgcagtggagtgatcttggctcactgcaacctccacatactggattcaagcgattctcctgcctcagcctcctaagtagctgggattacaggcgcatgccaacatgcccagctaattttttttttctttttgtatttttagtagagatagagtttcactatgtcggccaggctggtctcgaactcctgacctagtaatctgcccacctcggcctctcaaagtgctgggattacaggcttgagccactgtgtccggcctaatgcgcgtaaattcttataacagtgctgagcacagatacgtaacactgttagttgctattagtatgtttagcattttggagaccctgtaccccattttattaaagagcaactttctataaccttatgggaaaagcctttgggacaggataccaggggttggcagcccagagtccactctgctcccatgttctatgtgagcacaggtgtgcacctcattctggatcccacactgttgatctgtaatctaggagcaataatgcctggcttacgtgtgggtttccttggattgccgtgaagataacattagatgcaaaatgcccgtagttttaagcagatctcacaagttataatttttctgctctgggtctctgatacatctttttttcctcttgccaagtggatcaaatcccattttgttactcagccatcagattggattgcagaagctcagataccaagatgttaactctttggactgcaccatcatccagctcaccaggcactgtattatttgggcaattagaaatctcttgagtttattatggaacctcattttaaatacatgtttttagacttggtgtctctgctgtggcgtataacaaatgaaaaatatatcacctgtcaccatctgacatggtgcagagttacttgctagtggttggtatattatgcacttccttgctctggaatgaatgaacacttcgtttattccaggggctggtttaattcactcctgtatctacagcacctaggaagtggcctgacacataatcctctctcaaatagctgttgaatgaacagatgactcacagctcaactgaagcacaagcaccttttcatcaacaggttcaaagtttcagggagaagaaacagtgttgctttagttgagagtttaaacagttagatacttagaataattatcatagtgtaagagctacatcctgtgggggcacaaggaggcctgggacctgggtcctttgcagagagttgaaaatctagttggggagatgatgagtgaaaggaaaaccaggacaagatggggaaacagtaaatgccagatcagagctttctgagtggagtgaggtcaaagaggaaaagcagatggaagaggaaaggagagaaaggacacaggcagacaggggaaggctttgtatagcagtggggtgggctcctctccataaaggatgagtgtgatttcaatagggaaaaagggacaagcagcccagaagggggaacatggaaagatgtgtgttcagccccacctgagcagggcacgtggcctgacgacatcaaacctcactgcacgtgagggaagaggaagaaggcagaggagttgcagccaggccagggaacgtctctatggggctggccaaggtgtttgattgatgttgcccagacttgctgatggtaagaatcacttgtccaaaaaatacaaaaaacaagacatttttaaagacttcttgggcactcatgaagtctgatgttcaagggcaggaagcattcagcatgggagaaagatgaagacaggaagactcagccagtctgctcattccactttcttctgcctgctttgttctacccacactggcagctgattagatggtgcccacccaggccggatgcagtggctcatgcctgtaatcccagcactttgggaggccaaagtggttggatcacttgaggtcaggagtttgagtccagcctggccaatgcagtgaaatgctgtctctaccaaaaattagctgggtgtggtggcaggcacctgtaatcccagctactctggaggctgaggcagaagaatggcttgaacctgggaggcggaggttgcagtgagctgagactgggccattgcgctacagcctgggtgacagagcaagactctgtctcaaaaaaaaagaaaaaaagatggtgcccacccagattgagggtggatctcccttcctcagcccactgactcaaatgttaatctcctttggcaacaccctcacagacacacccagaaacaatgctttgcatccttcaatccaatcaagttgacactcgatattaacaatcacaggcactcttctaggcttattgaaccagaatctccaggattctcctttgaaaaattcaaccagtcagtcaatcaagacaaatagcccaggcaagtttgggaagtacacggtataggtgatgaacagacatggacagctgggagtggagatatgatttgacaagagctgtgtcttaggaagaataattgggaggcgatttggaggtggggattggtggaggagaatggagattggaaatcagttacaaggctactgagaaaatctgagtgggtagaagtaagggctgaagccacggaagctgccgtgggtctaaagtcaacgggatgccatgagttagacccagtatggaagggacaactggtgggacgcaacagaggagagagaggaagtcatttaatgactgggaggctacaggaagggtgaaagcatacatagaaagaataaatttcaggcagggcactaactatacagcaaggtgatggccttggtctcagagaatttgtggatcttataataatgggtgttcctttggaagactaagaaattgaacttgtgggactggggtgttggagagaggcaggcctggagattagaaatgacccttttttgtaggatagtacaatttacttgtaaacaatgctgggatttggggcactgatccctgcagtttaaaatccacatatagcttttgactaccccaaaacttaactactaatggcctcctgttgactggaagctttatggataacataaaccgtcacttattacatcttttctatgttatatgtattatatactgcattctttacaatcgaataagctagagagagaaaatgttatgtagaaaagatatttactatgtattaggtggaagtggatcatcatctttacatagagtctcagtgggggcagaggtggaggaggtggaaggggaggcaagacaggcaggcgcactgggtagaacttttattgaaaaaaattcacatataagtatgccgtttcaacccatgttgttcaacggtcaactgaatatttgcagcaaaactggcagccaagctgagaaaaatgaagaatgaaaaaggtaaaatgctattcaggccgcagtttacactaagcctgtgcagggaaggaaagcatctaaaactgctgatccagcccaaagcatgctgtgcccacagtggagagtcgtatttatttagaggcaggctggtttgacttcatctggtgaggattacatcccctactagggccggcattgtgccttcattctctcattcatcagctaattccttacaggtactgtgccctggacttgtttcgttcaaaatacatctttttcccccctcagcaaaatagagcagagttgacaagaagttctgataattactccctaaacaataaatcactatgctggtgaagtgtgttaactctacatgggacatgaatgcgtttcaagggaaaccctctcaagacaaatggcaccaagtgctgtgattacagcttcaacagacatgcagacagggctgcttcaggccctgtgctgactgccaggctagcaggaactttcagaaacagccacagtaggaatgctggagagagggagccttgctcctcaatctgccatgctttgtccttgggagaagtggagaagacgagcacaggaagggagggtgctcagttttcacccacttgtttatccattcattcctcaggtccaggatggcacccagttgtcgcaagcccttgcgggtgacctgtgttcccagccgtcgtctccatgatgggtccatcctgaccactgtttcctttgttattcaggatgctaattcttgcaaatatcaccctttcaatcaaattttattgagcacctactattctataggtgcagagaaagggctggaatatgaaaatgactgtcccggtgcttgtcctcaaggaatatacaaactattgggggagatagctgcttatataaacaaatttttaaaaagactctcatttgatctaggtagaagctgcaccaaggtccaatgtttgaagaatccagggaggcttcctagagcagaacatagtgaatgggactttgagggaaggcaggaggcacagcaccacaaacagcatggtccactggggaaacagtagttgtttagaggataaatggatagagtaccagtggcatggttttatttttaaattgtattcccttctgtatgtggttttaccattgttgtagtcactttgtcattaaatgacttcctctcctgcctatgctgggtcccaccagttttcccttttatgttgggttttgttcacagcaccctggggattaatgtagggggtactagagttgggaagcagcagaaagcatgagagtttgaatggattcttgcaattcccttgttaaaatctttaagcagcagactgacaagatcatatgtgcaactttgagagatctctctagcctgagaatgaaataacagtaacaagaggcaagagagagagagaaccattcaaaaacaccatttgttcacacattcattcaacaaatattttttgaaggcctactctgtgccgggagacaggctaggtgctgggaatatagttgtgaccaaaacagtttacaagttagtaggaaagttgggtttaaataaatagacaccaaagtcaatacatatttataatctgtggaatgaatggaattccacgatgctataaacaagtatggcagggtgtttcatttcaatgggtgatcagggcaaggccttttcaaggaaatggcatttatctgagaccaaaagaataagtagaatttaacctgccgtctttcaaagaaagactggaagcagagaagccaattaggaagctagttcagttatcccttgcaaagaagagggaatgccattggaaatgtggggaagacacctgattggagaggtctttttggagatgcagagttggcaagcctgctgcaatgtgttgagaagagatgaggctatgaatcaattcagattaagatagcatggatttgaaagaggtttggagaggaaaatccataggactgcatgaagaatagtgtggagtctgtgtcagggatggtgaagcctaggatgattgctggttttctggctctgtaacttggacagacagaggcacaaggaaccataggtggcagtaggagctgatgattgtttcagttttgagatgtgtctgagattcctgtggcacatccagggagatatgtctacacagtatacaggtgtggcctgggctgggtagcatgtaggaaccaatcaaagtacaaaggtggatgagtccagaatgtgtgtaggatccagcaaaaccattgctgagccatgcacctgaaatgtgaactgatcctatgttactgacactcttacatcagacatgaaagcaagagacagacaagaatggtggcaaattgataattgcatctcaatgccttttttaattcctaaaattactcgaagtctcaatttaatgcaatttcattctgttcatttaaagtccattatccaattagcaatggttctctctggggcttgagattgggaagaggtggttgaggggaacatttcacttatgttatgaaacttttggttttattttgcagcaaccaaatattccttatataagcaatagataaacagagtactttaaaatatttgtttacaataaaattgggcttcctttcatatgttaaatacaacttatgtgccagaaaagtgtgaaaggaaaatagaatcttgggaccccaaactcactatgccaaaggaaaagttaagcttgggaactgagtcatgtaaaaactgccttccttctgtccccagacagatagctgtaatttcacatgtttactttctcttatgtaaaatatagatttattgagcatgagaggaatgcataattgacttattgttctactccctttcttttcaaatacaaaatgtagattcacggagtgctaatcagagcctcacaagaatggaaccgcttgcctcattacctattctgacttcttcttatttttttcttttttcttcccctccttcttgcactttcccctttaaatattaaagttctcaagaccctttttggaaaaagcaaaggacacaggccctaccgtgacttctgtttctttttcccaggtgcatcctcaacacaggcaaaataaacctctaaatggattgagatctgcctctgtcacttttggtttacaaaagtgtatactgttaaagacttttcatacactttttttttatttttcaaaaagaaaaaaaaatttactcctcctcaccccatcaaaagttccacccatgacttggccactataaatgagttctggagaagtggaggtggctagggaagcaaggactgaagatgctcaaacactgggctgcaagcatatcagggtcctgctcacagctaagacctgctcagggccatccttttcttcaaaaacagactgaaacacggagggttttctctgaagccataggttgtagaagtccttgggtgacaggtgattgactggaagtagaggcgtataggagatcctgaaaatggtgagcattgcagagattccaccttttctcaaacccactcgtgtctgctacacattgacggtgactttgcaaataacacttctcggctgtctctgtgtgtttaagtggcacattgaaaaacaagacaaaggctcgtgaaagtgcatgtaataatttcttttctaatgaaatctggagaacattcagactttttcttctttaacggtgactcattgatttgtttatgactcaggaaaacttacccactggactcagttccctgactctgctcatgttggttgttgtcttcttcctggggtcaaggattgctttgatgatctcactccttctacaaactcaggggggctattgaaagatcatggctgattacagagttccttttgctatggctaagactcagtcacattcttaggaaaagaccaaaatgtgctaatgagatttttcaaataagcaagataaaaggagtttttgcagagaggaagctaagagttagatttagttgtataaaagatataggagaagcagggggtgatcagctctggattcactgtgagtccaggaatctcagatgtgactgttaacagtgccctgttttagttcaatagcacattttaaacgaagataaatgaaagaaacctctttaaaagaagatgaggctaagaaaaaggtattcgttctaatgaaagccgactgttctgcttgagacatctgcttgtttggtgtcatcttgctgtacagggccacactatgaggcatgtaggtcagtagtgggaagagcagttgatgagctaaacgaagcaaaagaaaagccaggcaattggttaactgattatttgggcatgtgtgcatcagacacttaattcaacataccttaaatgtacattaatcagtcagcaatatcatctgtgtgacaccgctctggaaaaccaaggcagaggagaaaaaataaatcaaagaatgatctacttcttcatctactagagagacaaattcactcaaaatgacttttagacatttctagaactatttcaaatgaagtgggctgcttaggaattgaagcagatcaatttggaagattagaaaaggagaagcttggacgctgtttattttaccattgcatgtaggagtcaaagtctcactcctgagacacaggcaggttgtgctgaataaggtcgtaaaccactaattctctctttctgatgaccctgaatttctgtcaaattcaatgattctgaatccacatagttaaactctggcacatagttggtgcaggaatttcaaggtccaggtcttactgccgaggtcttagcagcctggcgaagtgcaggtccactcagtgctgcagacactggatgtttccatctggcaaacagtctatggggtgctacaaattttcccccatgtaaagtctcacaaggccacataaattttccaaattacaatcacttgaacccttatcctgctcagttgcaggacagcaaattctgctctccaaggatatctgggaagcctcagggatttcttagatgttccccagtctctcttggttgccaggccagctgccacctagctcaggaccactgctcaatctgctctgcctgtggttcacaccagctcttccgcaagttgccttctgcagagaaagcatttctgtgcttgttgtagaattctcctttttctcagtcttccataggttgagcatcagccactactcctccagcaaatgttgccaagtctctctccttgagcctctttctgttcggctttggggaatcatcacactaaaagccccgtggtcatagacaagtcttggctttgactatgggtgacatgggtgctcttgcaggcaccttgcctaccaattatcatcatcttgaccaagtgcaaacagtgtctgggcacttggcctctgctgctactggcaccagcccctcttttgaccttgttgctgtgccattgtagccacctgcacaggaccaggcagggctgcctcttgcccagttcaagatgcacctgctcttctgggctcccccttctttccaccagagtaagttacaaaggttgtcttcctccattttagtgattgcccatctgacctcccaggaactgaggtgtgggggagtctgtgctctgagtctaagcaggtagatctcacccctctcctttggggcctcttactacatatatttagagaattaggaaaatgccagcacagagccaagtggtggttcaggctgttcccatgttgtatgcctcatgagccaagataccaatttctgcctctttcaaagcatattgtagtattccatttttggcaagattctctccagagtcctgtgtcatttccaaacagtctcatgaatcacctgtggctttaatccacaaagcagcatatgctaattgctacagtctctgataagtgtagggtacagtgtctgggtctttagcctatatttattcatcccagagacattaatttatgcatttatgcatccattgaagaagcacttattgtgaactctactatggactaggccacgtggtaagggaggtgcaaatggatttgagacatgggtcatatcttccagtagctttcaatccagatggccaagttcacctgtgaaacatctgaaactgtttctgcttctatcctcactagagtgaccttaggcaaatcttttaagtcctctgggtctcagtttcctcataggaaaaatggaattaaaaacacctgtcatgcatgtctctttgaactcttgtgcagaacaggttcagattgtctaataccagaaagcagaattggagcaaatggcacaaaatggcaggttctccaatataatctcagaagggattaactaaccatccaaagtaaccaccataagtgtgctgcctgccctacagtgagctctctgtgcttgcaggcattcacatgcagatgaggtgggtgcttgctagagatgctgcagttgtgttagaaacttaacttcatcccccaagatgctgtgaaacacgtgaacggatgtaacaatgcagggtggtcttggtctttggttgagtttctttttatttaaaagacattcattgggcatctactttgcacaaaaactctgcgctctgcccagagggcatgaataggtgagaggggtggagtctctgtccttacagaggcaaacattttgatgaggagataaacacacatggtgtgaaagagtgaatcaagtcaaagaaaagtacagagaatgtgagtgaggacacctggagctcaaaaccttgagcttttaccctggagtgtgagtgctgtgtgcttccccattattctggagtcaaggtttatgagaggaaaaggaattctactgggctttggagcaggaaggacattgtaggtaccagagtgagctagacatgaaatgtgttctcaaattggagacatatggaccctataaaaatattttgaccatctaaagttgacataaacttttttttaatcataaagctatttaaatacagacaaaactgaggataaatttcttaggattatggtatagcatatttataaattatatatatactaaaccatgaaactaagaacattcatgtttaatttaatttaatttgatttgatgggtgtttttctgaacctaaattgctaataatagacttaagaatgaagtttagacatcaatttgccaagtgttgttgaagtaaatggaagaactaaaattcttcaggttattggcctgcaaagtcctgttcttgctcatcaaggcaaggactagtaaaagaagcaactcctaaagtagaataggagaataatcctagtattaaggagtgtggcaaatctgttgcctcctgccatccttggcatgtgcctactagcaggtaagtcatggggctagtccacagaactagtgagataaaagctaaactcccaaatctgtgttacagcaaaggggggaggggaagctgattagcttaatgcaatcatgaacacatccaatattaatgtgggcttaaagaggtttgcagttaatattgcagaaatacatattgaaaaagaataatgaacctctaattacataaggcttgggtcttatttcttggaataacgaaaatgatcagatgaggatttttagtgaatattgactgggaacgtttacaaaataataacaaccattgtaatcattgtgagtgaaggctgtcttgaatccattgaaaaacaacatgaggctactttaaaaagttataagttatttacaacaatatttttctgctattgcacagaatgtcattgttcagaattttctacaggttgactttgacactaagacagataatggattttttacccttctgcctaaaacttttccgaccaataatcttaattgacctctactgtctacctcatggcaggaacctgtcaacattaagaaagaaatacaaggtttattatgattgccctcttaaaatcctgctgcaaaggacactatttttactttattgtttttcgtccgaatttctttgttttcctttcttagtaagaagggcagctagtcactctaatgttttgtggctgcctgaaaatgtactgtgagccatactgaggttatcataacttggataaaacattggcaatatcccctattcagctcttgaaggaagtgccttgttttatttgctaagggaagtctgaaaaagggaaaaacacagttctcacaaataaaacacagattgtacagatggtagtaaaatatgtcttcagtctacacaagaatcattttacctgcagcaggagaaacaagtaaggctgggagacatcataactgcagtggttgtaaaacaaggctgtctttggatttcattactaaagatgaaaataaaatcatagaggtgtaaaaattgagaaaactgtcaaaaagcaccccacacctctcatcttaaaatccatgatctccttagaaagttctttcatttcttcaaggaactgataaatcctagggcctataaactgttccagggcagaaagaaataagctttcctcttctaacctgatgtcagcttaaccctcttgccaacagggcaaccacaaatgggaaaactacccaatccaatccagcttgaaccataaaagcaaacgtctttaatacagtgtcagcagataaataggtgtgtatttttaaaagtaatattcaaaggtcaggttccaggaatgtaaggatggtttaacatgaaaaaatctattaatatagtatgctcttttaatagatcaaatgatgaaaaatcatatgattgtctttatacatcaaaagataatatttaacacatatgcaaggctaacaagtcttattaaaatagatggaaagatgccttgtagtaagatatgagataaaaaccacaatacattcatgttatatatatatgtctgtcacatgtgtgcatacatcatactccacatctctaagtcacatatgtcttatcactgcattgaaacaatagccaatgtcatgttcgatggtgcaatatgtgaatagaggacttttctcaacagcatctaacattgttctggaaatgctataataaaattaggaaaaaatcagaatcagagtgttatactgtggtaagacaaagacagtttatattttcagataatatgtttactaccaggaaaacccaacaaaatccagtggaaaaactcttagaaccaacagaaaaactaagtaagccatctggttacaatatgagcatacaaaaagcaataatgtttttacttataaattagtatatttcagacatatagaacaaaataagaaaaccatagaaacacttgtggacccactatccagtttaagaaattaaacattgccactgcagttgaagccctgcatgttcttctcctgatcacattcttcccttagaggtaaatccttattgtgaatttggtgttgatcattttcatgcactttttaatacattttaaaatatgagctaggcatggtggcttacacctgtaatcccagcattttggggggctgaggtggtaggatcacttgaggccaggagtttgagaccattcctggtgatatggtttggctgcgtctccacccaaatcacatcttgaattgtagctcccataattcccacaccttgtgggagggacctggtgggagataactgaatcatggaggcagtttcccccatactgttctcatggtagtgaataagtctcataagatgtgatggttttataaggggaaacccctcttgcttagctctcattccctcttgcctgcccccatgtaagaagtgtcttttgctttcttccatgattgtgaggcctccccagccacacggaactgtgagtccattaaacctctttttctttataaattacccattctcaggtatgtctttatcagtagcatgaaaacagactaatacacccggcaacatagcaaggccctgtctctacaaaaataaaaaagatacaaaaaacaaaattatccagaagtgatggagcacaactgggaggctgaggccagaggatcacttgagcccagaagttccgagttgcagtgagctatgatcatgccactgcattccagcctgggtgacagagtgagtccctatctcagaaaaacaataaataaaattttcaaaaatgtatgtcttcttaaatttcattggctgtttggctgctgtctcaaggaaatggcattctactggaagggttctttgttggcccacctgtttcaatcagcactgaatttgtgggattcacctgagtgggtgcgtggggctctagccatcattgccttactatgaattattatagtgcatgaatagagctctatttatcccattgtttgctgtcatgagcattcatatatatatctctttgtctcaagtgtttctccagatcccagggatctagagtacgtaccagggactgaagagaatcccatatcttctcttttccagacagaacccacagctctgaattcatgttccaaccagcagtgcacacaagctctcacagcctcacacccgcccccaaacacttgctcttgacaatcaacattttacgataccaacaataaatatgcagaaagtataatgaaaatagaagattccatttgcaaatgcagtgataaaagttttagaaataaaattagcaaatgtggtatagaatttatgtgaagaaaacaaaaacttttctttaaagactataaacaaagacttgaggaaataaaaagtgatacattttccttaggtacaaagactctaaattgaaaatataaaattttaaatcttatcttaaacaatcatggctactttcccatatacatatttttttctgttgcacttttcataagtataacagagaaaaaatatatatgggaaagtagccatgactgttaaagaaatgggaaagagggtgaaacaagtacaaccagatactaagttattttattacacactcaaaacagtacagtgctcatgcaagaaaatgagactggccactgaaaccaagtgtggtggctctcacctgtagtcacagctactggggaggctgaggagggaggatttcttgcacccaggtgtttgaggcaagcctgggcaacatagtgagatgccccatctctaaaaacaaacaaaaaaaaaagattgattactgaagtggtcactctagaaaaaacctcaagtataaaataaatttaaaaagtggcgtctcaaatcattgggaaaaagatatattttataaatgtattgggtttttggctaataacttagaaaaaaacaaatctgaattcttaccttacgatgtatacacacaaaattcagggtaattaaatactttaatttaaaaaataaaattaaaatgattgaataaacttctcagtgattttgtctatgatattgggcacaaaaccagaaaccaccacggagagatttgactacaccaaaatgcaaatctttggttcaatgacaaaatctatacatataaagaaaaataaactagaaaaaatattataaggatagtctagacataagagtttctatcaatataagaaaaagacatatctcaatagaaaaacaagtacacaaacaagcaatttgtaaaagaagaaatataacaccatcagtaattaaaatgcatattaaagcaataataagatacccaggatggctggattgtggtaaataagcaataacaaatcatgacacatttttggagggaaatttgtatatatttcaaaagtcaaattgtacataacttttgacccagaaactctatttctagaaattcatcaccagggaaatagagacagggaaaaatgtgtgggcagcagcgggtggtataagagtccgcacaggaaaccagataagcctgggtctgaatctcagcccagtgactttctaagccttggccttctcataagtataacaaaataattaatcacgcctcttagagttgttgtgggaattaaatgaagcaatgtgctttgagtgcttaacaaaacacctgacatattataagtactctaaattttcactactatcattgtcattactattaaggtctatctatagataggcacattgcattaatagtaatgacaatgacagtagtgaaattgtcattactattaagtaatacagccctttagtcattgaaatgatgatgcaaaatcaagtctactgacacagcaagatgcctaagatatagtattaaatgaaaatgcaattgatatacagcattttaatataattatatttctgagctctctctctctatatatatatatgtatgtatactcttgctacctcaggatcaagagtgctggccagtagctacttaatgtaaatctgtgtaagtggtcacataagttctgtagttaaaaaaagaaagtaaagaagaaagaaatgtttatcttgaagatttaaataaaatcttttgagaaattttatattttatccttagcaaactttaagattatgactaagtactaattattaaaataaatgcataataaactctgttgatcaatttttgatatattttttcttctaaaatgtgtatgaacaactattaagcacctacggtgtgcaggcactttgcagatactgaggacagcaaagaatgaacaaaataaatgcttacccatgtggagctcagtttctagaggggaagacagatgaagcaaatcagcagacgtaagtgcttgaggcactgtagatgtaggtgaagaatattgagagctggtgggaagggacacgctctctgaaggggaagcagagggaggacctttgggaagtgggtatggatccctaggggaagagagctctaggcaagggaacaagtggtgcaaagaccatgagctagggtcatgcctgacgtgcttcaggaacagcagtagggcccataaggctggaccagatctgcggagacagacaggaacacgtgcagcaaactgaggaggagcctgcaaggaaaggaaagtcaagaggattggtcacctggacaccaagtgaaagaagcgtttcaggaagcagagagataacttagtgctgagaggtcaaatcctcaagaactgagaaaaaccattgcattggcaacctggaggtcactggacaagggcagcttccctggagaggtggcaaagaaagcattcttgcagtgagagaggacttggcgacaagagcagataattcatttaatgagttttcccatcaagaggagcagaaagatgagaaagaagttagggatcagagtgggttaagaaaagggttcttatttggctattggagaaatggcagcctgtttgagtgacagtgaagggaatgatctggtagagaaggaaatggacgaagtcagaagagaacagggctggagtcaggcccaggagcagtgagagggatcagatccagggcccgatgtcagctggccttggcatcaacagttcacctacctaccacattcctccccaccctggctttacaacaggtgataaaataggcccccaaaaggcccccctggggcacccaaaaaactttcattgcccaggccacaccacggatcattcaaataagtgcattgccttaatgaaggtcatcttttgacaaatttccagttttcctttagtgtcaatttatattttatttgactctgtcaccatcagtgagagactacctagctacgattctcaatttatggatagcgttcactggggagggaggctcagtgagcatccgtctctctctccccttctttcttataactatgatttactaacataaaagtttctaacacgtggcagacatttaatacatttactaaatcaaaataaaacaaataaaaaaatggttggaaacagctaaacttaaaaggacacttctctccccttccaggcatccatggatgtgtcccaaaccaaagtgatggaaataaaccagatttcaaacttgggatattcctgatgattccagggaagataacaaaacccagactttggcatcagtttttagttctggagtccaaggtcaaggcaccaatagattcagtgtctggggcgggcccattcctcatagacaatggcttctatgtgtcctcatgtggcggaaagcagtgatcatttgcatacttaatgcccagatattttcacatggtagaaagcagtgatcatttgcatacttaatgcccagatatttttcacatggtagaaaacagtgatagtgggcatttcctttgctgattttgttgttcttgctagttataatatttgctttcttttaaaatgttgattataagcactcagataataaactagcaaaaaatatataggaagtctagaaggcaatatactacattaacttttttatttagccttaaaaagaaaggaatttctgatatatgctacaatgtggataaactttgaggatattatattagatgaaatgagccagtcacaaaaagaaaaataccagatgattccatctatgtgaagtatccagagtggtcaaactcatagaaacagaaaggaaaattgtggttgccagagactagggggagagagaaatggggattgtgtttaatgggtgcagagtttcagatttaaggcgagaaagtgctggagattggttgcccagcaatgtgaatacactcaatactacttaacacttaaaatgggttaggataaattttatgtgtattttatcactataaaaaattttaaaaagaaagaaggaaaatatgagataaagagagaagaaagagaaagaaagaaaaaagagagagagaaaaaaagaaagaaagagagaaaggaagggagggagagcaggaaagaaaaggaaggaaggaaggaaagaaggaaggaaggaagtgagggaaagaaggaaggaagggagggagggaaggaaagaagggagggagggagggaaggaaaagagggagggagggaggaaggaaggaaggaaggaaggaaggaaggagactgttaccaggctttgtttcagggctgtaagagcttgaagattgcgtggacattggaatgagggaataccatgtcctctgaaagtcatgtttagctctctggatctgtaaaacgttaggattccttcctcacacttgcaaaaaatttaattattgaaaaagggttttataacatgatttgtagcctctgttttgggtttagaccaagagtactatgaaagcctcatataaatacaagttttaacattttggctagttgagtctgaggaaaaaaatgaattttttggattcactttcaatacaatctatttttccagtctctagtttacagtgtgattcatttcaaaagggatctatttaaggcaatggggctttaagcaggacttgcataaaatgaagccgctgcttctaattcatcattcaggaacccaaactttgtaattatgtggccaaccatttccaatcatgactcagccggtcgtgaatctaaatagaatggctcacccactgcaattacgtaagttccccttatcaggcaggttgacagtcctcattgctggctttctgtcaacttttacaggagacttctctttgagatgtgcagctgtacctccaggctccccagtcagcttgataactccggcaaggacaggggggtcacctgaggactggaatcctgggggtctcttcatctaggcatgaggatgagactccaactgctccatccccctcacaccccatcatgatacttgaagtatagacattattcagccactgctttttgatctcaagaggccacatcttcagtgtggtatatatctgaattacgtactagtcactcctcttgtgcattataggttcgtggcttttaaaaaaattcagtcactggaacttcagaagtaatacgtgctgctggtaaaaatccaaacactgccggagaatctaaagtcaaatttaaaatgctcccttccctccttctaagtctacccctaatgaggcattttggtatattttcttccatactcttttcttttcttaggaatgtatgcatgcatgaatgtgtgtatgcatgtgaatgtatcatgcatgactgtgtataagcatgtatgcatgtgcgtatgcatgcatgaatgtgtgtatgcacgtatgcatgggaatgtatgcatgcatgtgtgtgtatgcacgtgtgcatgtgtgtatgcatgtgaatgtatgcatgcatgtgtatgcatatctattctttttaggtcaaccgtatcatactaaacactgtattcattaatttgatgtttttcactcagccattttataggcatctttcaaatatattttgtcaacctcattcttacaaattgccgaatagcacatggcactcagtcatccaggatatgcaggcagtttgccatttcagaccaagctgtgacaatcacttatttgcctacattcctgagcattgattcttttatttctaacagatgatgtccagaagtggtaatgctagtcccaataatatatgcatttttttttttacctttacagatgacactttcatgttctttttgaacttttttcctttttggcaaatgtagtgatcttgatatgggcaaatataggaaaattgagggcatttgtgggagtagaatctctttcgacccaaactaattgatatatgttcccaaacacgatgctaaggtttaagaaaatgcaagctatttaagacatgattaatctgcacgtacctctaagtttcctgattcactgtatgatgtaactgctaaactgcaagaactctttactgagagtttagagaggtaaagaaagacaagcactgcgtgggtaggtgctgataataatgatgaagacgatggtaacagtaacagcctcggctgaccttcatccaagatgcgcttggctgcttatggctggtgttcattctgaccagtcagtgcctatgctaatctggttgtaaaatatgtttaatatcaccgctgaaaataataccttccatttattttaactgagcacaatgatctcttttaagactcacaattctagatggaagctatggttatcacctccatcacctcaaggaaaccgaggctcagagatcaatgtgctcaaagcaagcagctaggaggtaatggggctgggatttgagcctgggctggctggccatatgctattgcttgctgcagtggcatctgtgttggtgtaggcagaaaagactccacagtgcaaggtgacttagagaaagtattgacaatctaataggacaccaggaggagaggagagcatcctaggcatggtctgggcaaagcccctgagctgggaatgagagagtgctggccactgatttccttctgtctgaagacaactgtgggctcttggggattttgcccaaaccttcctccccagtcttgtcactccccattgttcttggcgttctgtgttcagcccagttggactgtagaactcactactctacaaacaggctttgacacttgttataagtcaccctggctctctttcctaatctgtgtctgcccacgttggtcacccttctaagcatattcaatccatcatacccctcacagaatcaccttcatccttcaaggccagaaaggtggtccctcgcggagctctcttggtctgatgtttgcacctctcctaaagcgcaattattttaaatcttagagctattcatgggcatggtttttggcacttactctactgtaggctctgtcactattctaggaacactcatagtaggtagcacctagcacgcactgcacacgcacaataacaaacagtctgaatattttagagtcaagaaaaaggttttcaaaggaaatcttgggcatcaaatgaaggattgaggcccaaaatcttattacccatatgataattattggaaatcattgtttatcttgacacaagtttgataggtgcatgctttggtgagattgagtgaggcacagggcgaattcaaagacagaattctattgcttcactaaagtggagtaatgggatggagaagaatgttatatactgctgggaagtatttagaggatatatggtttggagacagaatatatggttaatgaggaaagttgggcagagagatggcctcaaggcaggaggtgcagcagaatcaaaggctggattcagaagtgggctggaaagaaaagggaggatggaggcaaaggcagcttgaaggatctcagactagagatgttgggtttagagaaaggaggaagattaacaactgaatttcctaatttttgtgcttttaaagctctggctgccccccacttggcattgtgcaaagacgtataaagttacacatctctggaaagttccttttggacaaagtttgtgaaaaatacattattattatgttaaaatcacacatatattagaagcaggaaatgttaatataaaaaagtaaactaccaacaatttcattttagagttgggtttttctgtgttccaaactcagactacccaggctataaactcactgtatctgctgtaaggacctagtgggggcagtgtttgagaaacgctatgctgaggtcaagatgctgctgagaggtcaggtgaacatgtccagagtcagggaaatatgggaggtagcaagaggccgcctgtacaagcccctttcccaaggcggggggcagaagagacttccccaaataaaatccccacatgctgtgcctgtctagacatcagtatctcggagaacttgagcacaccattttttttttttttttgagtttccccaagtctcatcttgctaggaaaggaggtctaattccttctacaattcgtcacgtttattcctaatgcattcagtcattcaacagatatttatttaattcctgatgcgtctggcatggtctgaatggcgtctttaacttgcttactttcttctgaaagtctcttatcatctctatattgctcataaaacgaggacctcgaccaggtgcggtggctcacgcctgtaatcctaacactttgggaggccgaggcgggcggatcacgcggtcaggagatcgagaccattctggctaacagggtgaaaccccatctctactaaaaatacaaaaaattagccgggcgttgtggcgggcgcctgtagtcccagctactcgggagactgagacaggagaatggcgtgaacctgggaggcggagcttgcagtgagccgagattgcgccactgcacttcagccggggcgacagagcaagactccgtctcaaaaaataaaaaataaaataaaaataaaataaaataaaataaaaataaaaataataaaataaaaataacaataaaataaaataaagcgaggacctcaaagggcactgagtcatcagctgtagtttggtcacgtcacattagaaatgaactctccctttccttgttcaggatgtaggacttcatccgggaaggctaaggctgtattggcctgcagggaaccccctctcactatgtacttactgtagatttgaaatcccagattattttcctgctactcctgcagactcatatcttcctatccatacctactcttttggagagttggagctctgatttacccacatagaggttcatcccgctagtccaggctgtggttaagattgcggtttcttcctgatgtgatcccttggatcctgacggggatatgagatgtatttgttcacaccacgggctgctgagctggccttgcacctccacatccctggacaggcttggtgaaagacagtgggtaagatgaacagggagcatagtcagatttatcttctttctcctaaactttaactctctataggaaactttgcttttcagtgaacttagaacacaactattacaaacagattctgtgtattctactagtaacaatgggaatggttaaaagtgctgctagcaaaaagtatgcagtgagctcactgtgaatttttatggggacagtgacttctttttaaaaaccaactaatttttaattgacaataaaacattatataaattgatggtatacaatataatgttttgatatctgcatacattgtggactggctaactcaagttagttaacatatatggattacctcacatttttctgtggagagaacacttaaaattgactctcttagcaattttcaagtatatattgctagtaactatagtccccgtgttgtacaatagacgtcttgaatggattcctcctctaactaaagttttgtgtctttctccctactccccctgctccccaacctctgcaacccccattttcctgtttctatgggtttgccttttttaagagacaatgactttctgttaaggctgtagatacaacactggtgaaatgtgttatttcacaaatgactgactctaacgtgtgtgtgtgtgtgtgtaaataaataaaatttgattttttatctgagcaaatttttgttcattacccaaaagaggagttttttaggttcagggagagcaaaataaagttccttgatatgttaatttatagttcctctctgtctttgctcctggccttcaggagggtgtcagtaaatggcagccaatgaattgccagacaatcctgccttccaatgctgggagactggcatagcaggaatggcagcaggtaaagggaccgtcaggaagctggtggatcctggacaaacatacccgagactcagtttccccagtggcctccttgtctatgtcataatgttgtagtgagaagcaaataacacattcagtgtgaaagtactttacaaactggaacctgctgttcaaatgtcaagcgttatcatttagtaactccaggattacccaaatttacactgagacatcacccctcacatgattaacaccttggttcacacaagagcactttaaatggttgataggttcaggtcaggtaatacagaagaagaaaaattcaaatagagaacaaaaagaaattggtcattgaaaaaaacaaaattacagtgtttgaacgtagagatgagccagccataagaagcccttggattagtaagtttatggtgtcaggaaattgactgctggaaggtgttttcaatgatatttcattgagacaaagaggaagagcattgttagtcaggacatagctaggcttgatagtttccttcctgatgctgaaatagactctactgttttctctttgctttgtacttgttggtgtatcgtccccaaagctcactaatttagttcactctttcactatgtgtccctgaaacatctacacagaccttcaacaaccaaagcgcttgcacagcaaaggagtcggatgaaaggggataagcagagggtcaatgtaaacaagggcagagagccgaagccaccacctaaaaactgatcagagccacaggagtggtcaccggcaggccactggcaccagttttctttcagtgtttgctcagatggcatgcagtgattgtctgttcctgtacctattctctttgattctctagaccctgagtccatgaggaaggcacaggaaaagcacatatccaatccaaacagtgaaaggtgtcatttaggcgtgtttctcccctctttaacttcagggagaatggaagaaaagtgggacagattgaatgataaatatactcacaaagtaaatgactttctcaggacacatatcatatttggacaagttttgttggccccaagctaaatgacagcataaggatctcattgtgtttttcattttattgactttaattggctcacaagtttgacaatttactgctgtaatcagtattattttttaaagccaatagtcttaacagttaagtttgcccaaactcacccagctcaacttcacaaattttaagatacaagcatatatattttttgacagtttctagtaccaagtccacagtgtggccataataagatatagtagagcaataacatataaaaaggttctttataaatggagctttcagaagttcataaaacagttgaaaatgagccaaaagtttttacactatggagaaagtgagagattgctcaaaaaatgcatttcagcataaattggtggacgtaaatgagtggaccacaaaatcttagtcatttgtcctatttgcaaaggggctataatttgtctgctagttattttaatgaatatcctttgtatttgcttggatttctggtttcctccccaatctgtgtgcagatgacggtatttttaaagtaaaggcccatgtataaaaggtgcagtggttaaatgtgggaaaggccatctcagtcttccaaccctttctctttacccacaactccaaatcttagatttgaaggtgcctctggtggtaactcagaacctacagaaatcgtagagacatttaaaggagctcttcttgaccagggaggtgcctggctttctgggcagctacttgagttcccaaagacatcattgaaatatttggaaatgcccctgccaaaatatcccagccatctgatttggcctaagcaatgtatagtttctgtattttagtttagtttcaattcagtacttagttgtttccttgcttgggaagaattctagaagaggcaattgtccatcgttggctggttttacttccctttgtttttgaaaggctctgtttttttttttatgtgggatcaaaataatattaggaggtaaatttggaggatgacatttctttagatgatgtgaaaaacaattcagccttaccactttcatgtgctagtagggctgacatagagagtggaaagaaaatgtcatagacatctcctatacaagaagtaatctgatcattggcaaacatgacaggttgctgagaggagagcgagccttctttcaaatgcttgcagatgctcactggaaagagatgacggcagagttaagcttcctttgcctgtactctatttcatgtcgtgttattaatacattgtcttccaaggggaccaaatgagacctactagtcttactctgaactggagtctagctttacatccttgtctggaataagggctgataaacaaaaacatgtgtaatctgcttttctggggaccctagaagagagagaggtgtgtgcttctctgaggacaagagaaggaatgagcacagtctctgaagagacagaactcttaggatttatcatggtgtgggatcagccacatttttatcaactcaaagatctcaattaggttagctgatgaggaaaagatactttctgcacagctgtttgatttttcatcatttgacaagacctgcaaaaaattacttttatcaatatacaaggagcatatagtagctcgttgttcagctgaagtggccagtggccaacatggtgaggcgtgaggcatcctcctgatcccaagcctcctgtctggcccagaacagctctgcaattaccctcgttctcactcccttgggataagtagtgatttccaaaccctggctatacttagagtcatctggaggggatttaaaaaaaatactgatatctgggttccactccagacctacaaaatcagaatatttatgggtggggcctgggcatttggtattttttaaagtgctccaggtgattctagtgttcaggtaccagagaactagagggcgaggactattcagtgactccatctcttctgttaaacagagaggttttctggcagagggaacacatgacatcaccataagtcatcaagaccatttacaccggccgggcacagtggctcatgcctgtaatcccagcactttgggaggccaaggcagtcagatcacctgaggtcaggagttcgagaccagcctggccaacatggtgaaacccccatctctactaaaaatacaaaaattagccacgcagtggtgcatgcctgtaatcccagctgcttgggaggctgaggcaggagaattgcttgacccaggaggcagaggttgcagtgagccgaggttgtgccattgcactccagtctgggcaacaagaatgaaactctgacacacacacacaaatttacacctttgctggaagcatctggcaggagatgagtctagtgttggaataggtgggttgacactgatgagaagtgaggaggaaaatgccaatgactctgggatgtcagagggcctagaaaactaaggtgaaaatcatgccaaaggaggtttgaaaaaagagaatgagaaggcacaggaagacaaaattaatttagtttccaattttgccagggccaatcaattactggaacagcaggtggtgggtgagggatgcagagaagggaattaacttagaactttccagtttggaggtcagatggtgtaattcattatggaagctgaaaaggacatgggcaaatttttaccctcaaaatatttttggctgcaggcacaccgcccggggaaaccccccaggatctttatgttcaagggaatgagcagtcattattagtctgctgtagtccaggaccaagaattcccttttggaacgtggctctcaattttacacttttgtgtagctaactcaacctttccatgagtaattcaatgcaggttgacaatttatttcctaaaatataacagtgccccattgtcatgcccggttgaagtgagggtctctgtggatcctgctaatagttgaaaaatcacaaacagccatcgtaagcagcatgaggcaaaaagcaaaaaccaaaagtgtctctcctgatgagaaatttttggaagtcagggctgtgcatgtcaatagtatggttgttggtagaaaaattttctttagttaatataaactcaattagtccttggttttaatttgcttttatttatttttatcaaaatataggttaggccatggaaaacagtgatttaaagatgtatttttcatcacctgagcccaagaagttgaggctgcagtgagttgtcgagtgacactgcactccagcatgggtgacagagtgagaccctgtctcaaaaacaaaaagatgatgcatgtaaaagaaattaccatctctgaaatctgaatgtcttaaaataggtagggttttatattaggagaaataaggttgctctcccaggctttaccaatctcctctttcctccatgttcacgacccattatttccaaaagctgtgacatttcctgtatattggcttatccctcatggcagcgtttctcagatgcatgaatgcttgactctactcctcagagaatagcagctgcctggggtcctgggctttgtctagatatactccctatcactcagtctttaaaccaagtgccactgaggagactccctggatgttcccaggtaacatcagggagagaactgaatggctttgtcatggaaattctcctcaaagcatgtggttgacctatttttgtattccagaaacacttttctatgcttcagttcaaaagcttagaattctgttaatgctcagcttgtagctctaacagctctaacaggcttacttgggaaaactccccccgaagcagaaatccttccccagcatctgtcatcaccagcttctgcttggtcctcatgatgggaacctgatgcttgctgagacagtctgtccactatttgatagaaagttctgcctaagaaaattcccacaatattcagtccaagaggaccccaactgatcccgagttcttcaggctcccaggggccattcctgcttgcagtaagcgaatgcccagaatccaaggctccatctcgcatgactgcaagagtctagtcccttcccgaggaatcccgggagtgctcacctgttgccttccctcctcactcctgctccacatgcctactttcagatatatttgccatagtccatgcaccatcttggtgcacttctccgtgctggtggagctctcatggtctcataactcctcatgtctgaactcacacttgactcctctcttaatccccaaggcatagcaccatcgacacagtggtgtttaaaataccttaatgaagatctgacagtaatgtaagggaattagcattcaggaaaggacaactttaatttgaaggcagtggctcatgacaccccatcaggcccatgtggctgtctccctccttaggctgtgtgtgcgaacattttgctgggcccatctttcctatttagcatccactttgtcatttcctcttctccagcaagtcccaggggctccagttacccctctctgccgttccacccatctccattataaaaaaatctctcaaagatgcccatgatgaaaatagccttttctattaatgtgatgaaaatttaacatctcagttttaagcatttacattgggaatacttcccaaagttcaaggacaacaaaaagcttcttgttttaaaactttcagaatgtaattactcacaaaagtgaaatagagtctttcccaagggcaaactcaccctttacctttagaggcatagggcatatatttctggcattctaacaaatagcagtttgttcccaattcagactgtcaaaagtttggaaacactgtggttcagtcacagagcctgctactatgaagtttacaaatgcataccaactacaggtgtgtgaacatacaggttgcacaggcaaatgaagacataaaacaagtgtaatgccattgcggcgaaatttggagtgcatactgtctaacatttccttttacaatatctaaaaattaaatattacattaaaatgaaaggaaactcattttaacctgaaatcttcccaatatttgcttcctctgattctagttttttcctatgaaattaggattagaacaaatctaatctcttcaacatcattcaaatatgaagaatgcactcttgtctcatcaagtcttcccaaaatttttaaaaagaaatttaaccttatgctgtcatgtaggtttagcatgagatgtagtatttaatatcttgatcattaattaagaaaatggaaccagaaaccagagcaaaaaagctgaaaattctaaaaaccagagtgcctcttctcctccaaaggattgtagctcctcgccagcaatagaacaaagctggacagagaatgactttgatgagctgacagaagtaggcttcagaaggtcggtaataacaaacttctccgagctaaaggaggatattcaaacccattgcaaggctgctaaaaaccttgaaaaaagattagacaaatggctaactagaataaacagtgtagagaagaccttaaatgacctgatggggctgaaaaccatggcatgagaactacatgctttggaagaacattccatgctcatggataggaagaatcaataccatgaaaatggccatactgcccaaagtaatttatagattcaatgccatccccatcaagctaccaatgacttttttcacagaattggaaaaaactactttaaagttcatatggaatcagaaaagagcccacattgccaagtcaatcctaagcaaaaaagaacaaagctggaggcatcacactacctgacttcaaactatactacaaggctacagtaatcaaaacagcatggtacttgtaccaaaacagagatatagaccaatggaacagaatagaggcctcagaaataacaccacacatctacaaccatctgatctttgacaaacctgacaaaaacaagaaatggggaaaggattccctatttaataaatggtgctgggaaaactggctagccatatgtagaaagctgaaactggatcccttccttacaccttacacaaaaattaattcaagatggattaaagacttaaatgttagacctaaaacataaaaaccctagaagaacacctaggcaataccattcaggacataggcatgggcaagtacttcatgactaaaacaccaaaagcaatggaaacaaaagccaaaattgacaaatggggtctaattaaactaaagagcttctgcacagccaaagaaactatcatcagagtgaacaggcaacctacagaatgggagaaaatttttgcaatctactcatctgacaaagggctaatatccagaatttacaaagaacttaaacaaatttacaagaaaaaatcaaacaaccccatcaaaaagtgggcaaaggatatggacatttctcaaaagatgacatttatgcacccaacagacacatgaaaaaatgctcatcatcactgatcatcagagaaatgcaaatcaaaaccacaatgagataccatctcacaccagttagaatggcaatcaataaaaagtcaggaaacaacagatgctggagaggatgtggagaaataggaatgttttacactgttggtgggagtgtaaactagttcaaccattgtggaagacagtgtggtgattccttaaggatctagacttagaaataccatttgacccagcgatcccattactgggtatatacccaaaggattataaatcatgccactataaagacacatgcacacgtatgtttattgtggcactattcacaatagcaaagacttggaaccaacccaaatgtccatcaatgatagactggattaagaaaatgtggcacatatacaccacggaatactatgcagctataaaaaagaatcagttcatgtcctttgcagggccatgaatgaagctggaaaccatcattctcagcaaactaccacaaggacagaacaccaaacactgcatgttctcactcataggtaggaattgaacaatgagaacacttggacacagggtggggaacatcacacactggggcctgttgtgggttgggggcaggcggagggatagcactgggaaaaatacctaatgtaaatgatgggttgatgggtgcagcaggccaacatggcacacgtatacctatgtaacgagcctgcacattgtgcacatgtaccctagaacgtaaagtataaaaaaaaaggaaaagaaaactgaagtaggccaaattaggatttgaggataatcagagccttcaagttggggtcatccattctagcctccagtttattgatatttctttcacagtgtccttgaaaataggatgttttgttaaaaaaatttaaagatatattttcagaataattccattgtaatctgtaatgcagtggcagatatctcaagtaaatggaggtcaaatgtttaaaaacacagtgtcatttgaaaagatgctgaagttcatttactgatataaatgatcaaaatggcaattttacagtgttggtcctttaaccttaatttgaggaaatggaagaataaatttgtgttgtccatagtaggtaccacccttttatccttaaatgctgacaaaggaaaaaagtgatacctgaagtatagcttagtaaaagttattgtaggatttcatattatttttaagtacttgtaatttgtaagtaaaagattttgatttttcttaccttcaaaaaagcatgtaactccatcaatcaggtaaatacacaatatagagtgatggcatggattatttatacatttgctgcttaatttcttaaattacagaattttgtaattattttttgttatttatttctagctaaatttcactggagccagagacaatatgttgtataagtctgatgttttgaattgtgttgagatgctctttgtgaaatagcatatggacatttttgttaaatgtttctcatgcatataaaacattgcgggctctgcagttgccaagtgtacaattctttacatggcaattgcttcatgttaattatgttgtcccaatcttttttattctttttttcctctgtgtgtgctaccagtcactgagaaatgttaaaatctctcactataattgcacatttgtctatttttccctttagttctgtcaatttttgatttatatattttgaagctgtgttatcaggtgcatataccacttgttatatcttcctggtggattgaccttttaatttttctttataaaatatttctctttctctctagtaatgcttctcgtcttaaagactgctttgatattaataaagctacaccagctttctttcagtcagcatttataatatggtatgtttttcccattcttttctgccaactgttgggagtttctaaataattaggctttgttttcttctaagtcttagaatgtttttttcattaaagcatttgttttttcacatttaatataattactgatacatttgggcttatagttaccatcttatatttgcattagctggtttttttttgttctttattttagaattttcaagtttttttctaactattccatgatctcctctattaattttctttttattttctacttcctactttttaaaaatacttagagattacaaggtgcatccttagtttaaggtctaaaataacttactagtactaagttattacatcagtctacttcttggacaatgcaaacacattagaaaacattaacttttaacatttaccacataatgtcttgtgtattattctgataaattttaatttcacacatcttaaatgtttttaagatgtgattattgttttctacaattattattcattgggatttattcacattttaaaaaatatatatatttttatttctcccacatatccatgcttttggctaagatcatatttcttctgcctgaaaaactcctgttaggttaatacaggtttgttggtgaaaaatctttatcttagcctaacttttcaaagatactttccctgagtgttgagttctatgttggcagttattttccttcattatgtttaaatatgtcactacatggttgcttggcttcagtcgagtctattaaaaagtcaactgtccatcttcttgttgctttccagaagataataggccttttccacactctggatgcttttaagattttctcagtctttgattttcagctgaaatgtgcttacgtgtaattttctttgtatttatattacttgagtttgtaacacttttaaaacctgtagtctgattttttaatcaattaaaaaaatctcagccattatttcttcaattacttctgttctactccgtctgcaccatttctgagactcatacaatacacacacaattcaattacacatatgttagacatttttaccatgccctacagttctcatgtctcatgctcttgtttacttgtttccttttctttctgtgcttcggtatggatattctttaatgacataccttccaaatcattaatcctctttttagtggtgtctaatatcctttgaaacacatctcttttagttattgtacttttcagttttagaatttccatttgatggtattttaatagatttcagttctctagtaaaattctctattttgtcttaaagtctgtcaataacagcgagagtccagtctctaaactctttttaacttagatcacctggggtgtgtttttattgtcttttcttctttttcctgtctcttatatgtcctgtctcttgatatacctgctaacttttcattgaatgctgtaaattgacacacattcactcatattctaagaaattgtagaggctctggatgattttaccttccaacaaggattttctttaactcttgatatggagttaggagcagataacctttatccaactgaagatgacactgattacagtctaattttcagtctatcaaaggtctagtctgtttccagtttacctttattcctagagtgtagtccttcaggggtcccaactgcaaactggaatattttccaggagctctccactttggttggcatccaatcccaatttttgtttccccaacagtgtaaagatgactgtagctctgcttagtttcttagccttctgcgcgcttttttttggtctcaatttccacacagtttttggactgcatatcttaagagaatgctttgaggaagtgacttaaactatcgaattttgttgtcttcacttttcttcacttgaggatcttggtatctcaagtcctgactactttggcaggcctgtatgtctaatctttctctcttctcttgtatctgcatatcaattgctgggcttagggcccaccttaaatacaggataatctcattctgagatctttaacttaattacatctgcaaggactctatttcccagtaaagtcacattgacaagtactggggtttggaacttaagtatgtctttgggggacagtattcaaactgtaaacacacacaaaagcttagaaaatatagaagagctatgtcaacaaatgttgccatcctgagctaaattggagaaacagggtaaatgtctaggaataacatcctccctgagttgtccacagaaacttgaatgttttgataggaaatgcactgggcagtattttatttcttaccaagcttagcttaactaagaggttggactcatgttagcaggaagggtttcttcagcctcatctacagcaggcagaggtcaatgctcacagggatatggcttcactgcctgctgcacagagcagttatttcctccacaaaggaaatgcactggcaagccccaggccatggctagaaggatttgaataatcaattggataggatgactggttctgtggacagcactcagcctctttccccagccacctgtcattgcccatgggcccatgaacaaaatggccatggtggcagggatggaggttacgcatgggctcagcaacatggacttctactcaccaaggctgacctggctacagccactgctgggagcccaatttgccagcagcagagaccaacactgagcccttgatttggcaccatttcttggggtgatcagccagctacctggtggcaggttgatgatatcggacctcttccaccatggaaagggcagaggtttgtcctcaatggaatagacacttactctggatatgggtttgcttatcctgcatgcaatgcttctgccaaggctaccatccgtggactcatggaatgccttatccactgtcatggtattccacacagtattggttctgaccaaggcattcactttacagctaaagaagtgtgacaggggacatatgctcatggaattaactggtcttaccatgttccctatcatctgaaaaaggttccctgctcctccatctaagcacgtaggttccacttgtggctgcaagcttggttcgtgtgggcatgctcaggttatatgacctttaaactaggggcccatggtaactgaaaaacaacccacaaccttgttacataaaaggagaaccagattggtctggtgcagttacacatgtaatgattgaagctgtgttattaataaaatgcttagaatgaatgattatctagacggaattagaatggaggacacagggacagctttataccattcagaggtgtctccattggtagagtctggagatggcagcacatgtctacccaaaagggaaatttcagatcacagcctgtcaacatccagactcctggggtctgggaaatgtgagagaacacatgaatatccaatgagccacaggttctctgccccaggtccccattcacatttcatcttgatctaacttcatcccagtttcgtattttccccaacaggctaagctactttttcttcttttctctcctccttttcccccttgtcttccattccttcatctctgtttcctaatctttgcttgatgccattatcgcttcccgttcacaaaagcagtctccactctagggggtgtaggtggaggggtcaattaaggctgcactgatcaccacattcaacgagttccatcaagtggcatccccttttcagaactgttcacttaaaccgatggttctcacacgggagtgtacgtcagcatcctccaaagggcttatgaaagcgcataattctggttcagtaggtttggggtggggctggagaatttattttttaaacgggttttcaggtgattttaattctgttgacctgctcaatacattttgaaaaacagttaaacctgcatttgggaggcagactatttccattttcatggatgtattatcatttagagacccacattctcttcctactaacacagctggggcagtgtggtcaggctgggaagcgtgggagcagaaatatttgttatttgttctgaaaggctgaggggtagttttgtggtcaattctaagaggtgcctgggcttgctggaagcagcttttcccattccttttgggctgccaactggggactgttctcttagcccagagctttgtcaatgggaatgtttacctggtgcagatgggaaaaacttcattcagcctgcactgagtggggtcccttctgtgtaatgtatgatgtaggtttgggactggctttttggtttgatggccaggtttactaacattttgcccaaatctaattcaaagaaaacaaggtacgagaataaaattgtggagtaaggcatctcaacattactgtcttctcacttcagaccagttaatgagatgttgtaaaagtggctgagagaactaacatgtgacccactgattgtttcccgctgatctcctgcgtagcccatccttacttcctgctgtgcctgccacttgtgtagggaatcataacttacaataacccctttctctttcagggaacacaaaaaataattaagatctaacttattgttagatatctttgtgaacagatgagtcctttctattcctcttttatctccacacctctttctctgttccaaatttgggaagccctcagtttgatagacatcttgagtctgattgcctttcacctccctggggacagaattgaattgagcgagtgtgaggatgccagatggcagggtagggggctgccttctgatgagagcagggattgagggacagggctctcactaatggtgtacgatatgattatactcatgctccgatagaaccttcagtaaaacttcctcgttcactaatgccttgtgcaatccttttatgggggttgggggtatgagcactaagaactcttaagttggcatcagatgaccccatgggatgacagccacatctcacccacaaggtccacattcagctgtaggagttctcctgggcacagaccaatgctctaggttggcaatgctgacattatggggactcagtatttaggttttatcattcttgtgaaatatttcccttgtgtcttttctatttgtccatatttaaattcatgcagcagacatttattgaatccttgctgtgcattacatgctgaaggaacaagaaagataaaggtagctaatgtttatatttttctttagagcttaaaaatgctgttgcacttatcaatctcttggatccaatactgcctctgctctcaaattatgatgatatcataaatatgccttgtttaactgaagtcaggtgtttgagaaaaatgaaacagtattgagaggtacaggtgttaaccttacaataagagcaggattttaaaggaagagaagacaattcttaaaaatggcaagatggattagacttaatgcctcacatcaatgaagggatttcaagtgagtggctgtgtattttttaatagaccacaaaaaaaattctatgtagaaaactgaagaattaaaatggtcgacagctttccttgcctatttttgtccttttctaaatgtactccttatggagagaagagtcgtgatgacagcccacagaagtgacgagtgcttggggtcaaatgggtttgctttggggttgccaggaaagcttctgtttggatttgctgccatggcctgcagcaaaggaagcctgcaattttagctctggaaatagtattcagcttaaggtaagttaaaaaaaaaataagcacctgtctcttctgaagacatgttgtcttagacaaatcattcttgactttctagttgagatgggccttaggttgcctggaactacataaagatccttggcgttcattcttccattgaacctctcagaaaaaaaaagaatgtccattctgtgctacttagggcacaaaaaagataattttggtaatataaatgagatagaatataccatggcactacattataatgatactttcctggaatgatgatggtggtgattttgatttagaaatctgcatgagattctgatcccacattccaaggagagctttggaatggcttgggggccttgtattccccaagaaatcttcattacaatcagctctggcaatttatagaagacttcaaattctgagaactttagtctgttgaatataaaaaagaaggaacaaaatcaatcccttcgtggaggggctacatgtcatatttacgatgaaaaggaaatgccatttgtgcattttaggttgaactttagaattcttccagctccactatacgaggcaaaagaaataattggtttgtagccagtaataaaggcaatcagccataaggtttgctttgctaagttgtccctcctgtcacatatatgtgcagttacacaccaggaaagggacagtgccaggttcctcattagccactgtgtttgtttatgctggggaagaagctgaccacttacaaagagccagctgtgcatgagccggcctcaccgtggtgcccatgaaggctgcagcccctgcctgcacagaatctatggaacaatactgtttatctcacctaaattggttaattacacggtttcattctgtgtgataaattcaatgataggggaggggaagaagcacatgtgaggaacacctgctcctcctaggagtcagaggaacgaggttgctctgtgagcgtgccagcaccaggttggagggtgccctagacattgatctctacctctgaagccaccaggtggggtatggagtggctggtggggtggggtctgatcctctggccagagaaatctcagctggcctctcggttcccctcaatctattaattacttggtgccattcaaatatgatcatttctctggatgtcactacatgaacaatattgggaagcaccatgctggaagataggtccttagagaagatggctaatgcaaggcttccagttcaagaaagagaatcctaggcagaaactaagcatatgaaaaagatcagagataaccagtaccatgacagtcagggtgacagtgtttgattcagctggagagaaggcagaagggagaggcaaagggccaggaatggagggccttataaggccctttaacctccccctaaatctgagcagagccattgaaggactataagtgggctgatcattccatctgttctggttagaggaggctggagcattggaacctggcagcatgcaaactgagtgagcagcttgggattttttgcagggaaacctgatcaagggctcaaccaaggccataacaattgttaaagcaatcttttgcaaactgtgcagtgaatcacaaatgtggattttaaaataggcctgagcagactgcctgtatgaattgaagacaagttctgtaactaccagttagggcagctgaatagattattgattctttaatttcaggccacaaagaaatcattacatggagttatgagagtttaggttaaattaaaaaaaattaaatatttttagcagagtacattttgcttgcctagggagattgcttctccagagccacttagaaatgtcttatacaggtactatcatggtggctgggacagtcaaacaagaaggtcagagaaaaaaggaggtgccctcctgggtacttctagtcttaggggattttattcttagagtgtgatgttaatcttacaactggggatttgtgcatcagccaccaggcgccgtgttatttccccttcagtctctggtaaccaatgattctactatgaccgactgacattttcgcattctcactgagaccctggtgtgtggatgtgtgtaatggtgttacattaggactgttctagtacttttatgttttggatgttggggcatggattcagaatagtttatcctattctgagccatgctgtcgtggaatttgctgagctgcgatgggtgtcttaaatatatgagagtgaatctctagtttgttagcatttggagtttcctgaagtgtaaccagttatgttgcctaaacaaaaggggatgtttgggcttgactttgttagtagaaacactgcctaactgcaaaagtacctgcagggcatgacggcgtgttctcctctgaaggtctttaagaatagcatggattccgcctgggcgcggcagctcacgtcagtaatcccagcactctgggaggccgaggcgggtggatcacatgaggtcaggagtttgagactagcctggccaacatggtgaaaccccatctctactaaaaatacaaacattatccaggtgtggtgttgggcacctgtaatcccagctaaccggggggctgaggcaggagaatcgcttgaacccaggaggcagaggttgcagtgagccgagatcgcaccgctgtgctccagcctggcagcctgggcgagagagtgagactccgtctcaaaaacacaacaaaccaaaaaaagaataacagagtcaattcctttgctcacagtggctaaaacagttcctacctgaagaaaacagaagtggatctcatgacatcttgagtattttgcagtcccattatccatttcaaaaacgagccttttattcagcctaacactgcatctaatagaataagatttttgagagtgagcttttgaaattataatgttgggatgttgctagatgctctttgagtgatgagattttaattttgaaaaccagcagtgaaacactcaccaacatgttccttctagatgaagctgcaactgcaagacagttgttactctttcgataactcgaaggcagttttaattattaactaattagggtggaaacagaggcttgtcattttcattattctcatggcacacattgttaataattttctggcttttggcatagtgatatagggcacttcagttatggcttaaaaaaggggaggagggcacatcttggaggtggattaaataaagatttagcttctttgcctcaggattgatatgtgccattttaaagcaaggctcatgagatctctggatcgagaggtcagtactaaatacaggaatgaaaatgctgcaggctctggggaagggaggtggttagttctgccctgcctggggagaaggggttcatagcaagcaatttcacatgggctttgaagaagtcagaatcgggtaaggatggggtgtgggagagagaatatatgacaaagagaaccagagggaaaaggacatggatgtgaggctgtcgagcatttattcagtcaacaaatatttattgctgtctgctatatgccacatacattctaagccctgggcacagcagaaaattaaatgggcatgtttctactttcctggaggtcctagtcaattgacagtgctccaaggattgtaagcagcatggtaaagttggcgtcggacagggagcaggtgtcacagtgtccagtgtccagtggtgaaagaccatgcgatgctgggtcaaggaactcaggctctgctctctggtctcaaggcagcccctttgctaagtggctctatggctccagattttgtggtaggaggacctcagccacccctccaaatatacccagttatttctgggagcaagtcccttgacgtgcctctcgtgcatcgcacaggttttcaacaacagtcctcttgcagtcttcaccctgtctttcctttcctgccctggctgaggctcccagcttcccgcggtatggcccaggtttcaagtcccgagaaaaaccttatcacacgggcaccacctcataggaacaggagagatccttgagtaagtgaggagattttacgtcctaattggagtagtgattacatgagtgaatacttttgttggaaggtactatattgtatccttaaaatgggaacattttataaattattttatatcacaataaagttaattttaaaagaaaataaaaattgtgatgtccatctttttagtaacctcaaatctttttacttattaaggagatctataatttatttattgtttactatgtattgaatgctatgtgttttacattaattattccatatacctaggatgaaaatactactatcatacccaatttgtggctggggaaactgaggctcccagaggcaaagtaatgaaggagctaaactggtatccctgcagtaagggttggagacaggattggagcacagcctttctcaatccaagtccttgcccttatccattctgtgaagcagcctcttttgtcacaaaggttataattttacttcctcagtaaaataaaaaagaagtcacctgtttagcatctgagctttggggtgctggtgtgggggctcagagctttacgcagggtgccacgggagtggccagcacatctccagtcctgtttctcgattgccagcccttcctctcaagtaacaatgctggagtcagcaggcaggaggctgtgaacacagcacttaatgattcagtcctgttgctccctgagccagctggagaagcctggctcacacagcccgagagatctctcaggcatggagctcaggtaaccttctccacctacctcttttttttttttttttttagatggagtctctttctgtcacccaggctggagtgcagtggcgcaatctcggctcactgcaacctccacctcccgggttcatgccattctcctgcctcggcctcctgagtagctgggactacagacacccgccaccacgcctgactaagcttttgtatttttagtagagacagggtttcaccgtgttagccaggatggtctctatctcctgacctcgtgatccgcccgcctcggcctcccaaagtgctgggattacaggcctgatccaccgcgcccggcccttctctttccatttagcggcatcattcttcatctgtggccaatgctatcctagaccatcactcaaggtgaagccagggttggactgctgtgtttagagaagcctcaggttagtctttgtaggttttgttcactttatagatcacccagggagggcataagccagtgggccattctcacccctgaggacggaactagacccttggggaaatccacacctcccctgccccaactcctgtctctgagtccatctgtccccaggatggactagaggagaacagtgatgtcccgcagcctaaagactgaagcctctcccttgccccacgccccatgaggaatcaagggtcactctgaagagaaactgaattgaaactagttccagttattgaacacctgagctaatggactgaggtcatccatctctatgtacatagtagtctggagtgtgagttttggggatttgggtggaccatggagggccaggccttctacagggcattgtccttctacgttctgggagagaaagtgggagaggagggtgttggccccatgggcaggtcacaccatagactcttacatggctatttgcaatagctctgagccccactcagggcagagaggggatatctagaggtggctctgagagaagataaaaacttctttagcaaatttacttcttgagagagggaaaaggaggggcccagtgacctccaggttgtacaaggatattctcctgaacccatcagctttcctagcacctaaccaaatggagacacatagacataccccatgaatggggatctaggaggatttcagataatattcaaatgtcttttcaatggtctttctgcgtccaaactaatttcaattcaaaacacacactgcttcatgcatggtgagatagaactgcttctctcaggatgtcacctcactcaaactgttactgtctctcaaggcaacattaacataggaaaacccacagtactgacctccacaccctgtctcccaaccttacaatttgtatcacaaacagtgatggaagaagaaagagaataaagaataaattaaggggatagatgaatgtaaaagtgaagattagaaagatgaagtaaagaacagagaggtctttctggggatagagggaccccgaagaagaagagctgctggtttcagaagaacaaaattgtggtcacctcatctcaaaaagggtcacttatttcctttatgggtcccatatttcctttatgggtcccttcctgccaccccttctgtctgaaactcattttcgtgttatccttttgtccttccttctataaactaaaaataaagacccaagcaacaatgctccaccccccaccccacccactgactgggcccacttatggccaagaggaccccagaaaatccttaaaagtgagttccttgcttttacactgttggtgggagtgtaaattagttcaaccattgtggaacacagtgtggtgattcctcaaggatctaggaccagaaatactatttgacccagccatcccattactgggtatatacccaaaggattacaaatcgttctactataaagacacgtgcacatgtatgtttatcacagcactatttacaatagcaaagacttggaaccaacccaaatgcccatcaatgatagactggataaagaaaatgtggcacatatacaccgtggaatactatgcagcaataaaaaagaatgaattcatgtcctttgcagggcatggatgaagctggaaaccatcattctcagcagactaacacaggaatagaaaaccaaacactgcatgttctcactcataagtgggagttgaacaatgagaacatatggacacagggagggaacttcacacatcggggcctgtcaggggggtagggggcaaggcaacgtagagcattaggacatatacccaatgcatgcgggcttaaaacctagatgatgggttgatgggtacagcaaaccacaatggcacatgtatacctatgtaacaaacctgcacgttctgcatatgtatcccagaatttaaagtaaaattaaaaaaaatcacacaaaacaaaaaaactgagttcctggccatgatgggatgggagatcagaggccttgttacatcccttccctttggtggttcagacacaacaattggccggcattactgttaaaatagagatcgtaagacaggcagaacagacgctttgtggcaacagggtgccaaattataaacagggcccaaggccattccaggcaagggttaagtcacacatccgtaaacttaaagaatcaactacattttaactgccaggaggttactctttttctctagcagctaaacaagcactggccctgaaataagcaatatggaagcaattgcagctcagccacctccaaacactgactaagccctgctgctccaccagccataactatagctttaattggacaaaacactgatttcagtaactttctccggtaagacgaccaccaactgtggactggatctgggcagtttacagtgggtgcacacttgcctgccttactgtcctgaaaagaccttttgacgtatagggcctaattgtaatacatttaaatgttaagtctccaccccaaactgaacatgggtcatatgttacacgcatgtttattcaatatacatgtgtcaggaccaccctcatgaatatttgtagttcttcctgtaacctgttgaatatgtatgtttagccagcctgttcagcataaagctcccaccccaaccctttctccttcaaagtgtccgtctctgggcttcaaccaaggcctgtgttgcccagccctcggggtggccaccttacaggtggcagctctttacaagaaatagtctcctctccttttccaaactttatgagtgttgttttttttttttgagacagagtctcactctgtcgcccaggctggagtgcagtggcgcgatctccgctcactgcaagctccgcctcccgggttcacgccattctcctgcctcagcctcccccgtagctgggactacaggcgcccgccaccacacccagctgattttttttgtacttttagtggagacggggtttcactgtgttagccaggatggtctcgatctcctgacctcgtgatccacccgcctcggcctcccaaagtgctggcattacaggcgtgagcaccgcgcccggccctgagtttttaaattgttgttaacatttccttctttccttcctttacttccctctcctctttttctttttccctccctcacttcctcattccttcctttttttccttttttctttcttttttgagaagcgccaaactctcctgtaatggtagagaaaaagaggatcacttaggagtttcgatggtttaatttctgggctagttcagatatgtcaatgtttttagtatcaacagtcctaaggacattttgcttttttcaccagaagctgttttttaattaagttaacgttgtctactgtctcactgttgattttcattttttttttttaaatcatgtaagatcttcctgtaagcaacttcagaatatcctcttttcacatttaaggctgcagtaattagacccagatttgctgagcctgtgggaatcctacaaccaaagtgatcttaatggcattttaatgtttgaactcttctgttcttatgtgcgaggttaccaagcagataaaagaagtggctttgacatcctggtgcttattagagtttagaaaatgccctttaagggtgaaaggtttgtgagtttttctttactaaatgagaaacagtgaaaccagcaaacctgtatcagtactcacaatgtattttgcgtttttggtctctttatacttcagatactttgagatattcttgggtaaatacttatgtaagaggattttatgaatgacagcaccttgattttatgaatgacaataccttgtaaatcaggaaacagtaaaaaaaaaaaaaagtgttcaatggtttgtaataggagagattttgtatcttcaaaggaaaggtatgtattttgcaaattaaagacaaggtggtatttggggtttgagaagactttgcatgagattactttataaagccttataaaaacacccagttcacagatgccaattttattggtattacctccatgtgatttatgatagatgatcaaatgaagaaaaagctaaaacagattaaccaaagcatgaaatcattattgtctcaggctgttacctcacttaaattttctccagttttaggggtccaagaactgtcacctggactatcgctggaggatatatcctattccccaaatcctacaaacttcactttcaattcaataataaaattctttgctggttgtttcctttgacccatccaattcttttctaagtgcgagataatttctaagcagagacccactttgttattcttgtagaaccagtccattagctcagtaatatttccctcctgataattacacagcacctgtttatgtcactgcattcatggagcactcattgtgtgcaaagcattatgccaggactgtaggacttcaagatacccaggacagtccttgagttgctgttctcttttggaaagtctgcaaaatgaatcaataagtgatttcaatacaatggtgtgatagcgatgtaacagattcctggggaagctacaagggcagactcacagttgagttgggaccttaaaatgcaggtcttgagtggtgtattagtctgttctcatgctgctaataaagacctacccaagactgggtaatttataaaggaaagaggcttaattgactcactgttccacatggctggggaggcctcacaatcatagcggaaggcgaataaggagcagagtcacatcttatacggcagcaggcgagagagtttgggcaggggaactcctatttataaaaccatcagatctcgtgaggcttattcactaccacgagaacagtatagggaaaactgcacccatgattcaattatctccacctgatcctgcccttgacatgtggggattattataatttaaggtgagagttgggtgaggacgcagccaaaccatatcaactggaaatacgactgcgggtatcagtccacagctgaaggttgagatcaccgatttacctaagagtaggggatagagcaggaggaagagaggtttggggaagctcaacatttactgagtgaatgaaggaagaagaatatcgggaagctccaggaaagaagttgtcagggagatggaggaaggaccagtgttgttccagaatcttcacttcccatcccagatccatccacatggagctgatatgcctctccttactgctgctagttccacct
